(12) United States Patent
Blatt et al.

(10) Patent No.: US 7,597,884 B2
(45) Date of Patent: Oct. 6, 2009

(54) HYPERGLYCOSYLATED POLYPEPTIDE VARIANTS AND METHODS OF USE

(75) Inventors: Lawrence M. Blatt, San Francisco, CA (US); Scott D. Seiwert, Pacifica, CA (US); Jin Hong, Brisbane, CA (US)

(73) Assignee: Alios BioPharma, Inc., South San Francisco, CA (US)

( * ) Notice: Subject to any disclaimer, the term of this patent is extended or adjusted under 35 U.S.C. 154(b) by 0 days.

(21) Appl. No.: 11/351,163

(22) Filed: Feb. 8, 2006

(65) Prior Publication Data

US 2006/0204473 A1 Sep. 14, 2006

Related U.S. Application Data

(63) Continuation-in-part of application No. 11/330,917, filed on Jan. 11, 2006, which is a continuation of application No. 11/200,531, filed on Aug. 8, 2005, now abandoned.

(60) Provisional application No. 60/600,202, filed on Aug. 9, 2004, provisional application No. 60/600,134, filed on Aug. 9, 2004, provisional application No. 60/604,280, filed on Aug. 24, 2004, provisional application No. 60/604,415, filed on Aug. 24, 2004.

(51) Int. Cl.
*A61K 38/19* (2006.01)
*A61K 38/21* (2006.01)
*C07K 14/555* (2006.01)
*C07K 14/56* (2006.01)

(52) U.S. Cl. ............. 424/85.4; 424/85.5; 424/85.6; 424/85.7; 530/350; 530/351

(58) Field of Classification Search .............. None
See application file for complete search history.

(56) References Cited

U.S. PATENT DOCUMENTS

| | | | |
|---|---|---|---|
| 3,645,090 A | 2/1972 | Mochizuki et al. |
| 3,720,760 A | 3/1973 | Bennich et al. |
| 3,839,346 A | 10/1974 | Gadekar |
| 3,940,475 A | 2/1976 | Gross |
| 3,974,281 A | 8/1976 | Gadekar |
| 4,052,509 A | 10/1977 | Gadekar |
| 4,211,771 A | 7/1980 | Witkowski et al. |
| RE30,985 E | 6/1982 | Cartaya |
| 4,560,655 A | 12/1985 | Baker |
| 4,657,866 A | 4/1987 | Kumar |
| 4,683,195 A | 7/1987 | Mullis et al. |
| 4,683,202 A | 7/1987 | Mullis |
| 4,695,623 A | 9/1987 | Stabinsky |
| 4,737,456 A | 4/1988 | Weng et al. |
| 4,767,704 A | 8/1988 | Cleveland et al. |
| 4,810,643 A | 3/1989 | Souza |
| 4,810,804 A | 3/1989 | Chandraratna |
| 4,877,729 A | 10/1989 | Clark et al. |
| 4,897,471 A | 1/1990 | Stabinsky |
| 4,927,762 A | 5/1990 | Darfler |

(Continued)

FOREIGN PATENT DOCUMENTS

| | | |
|---|---|---|
| EP | 640619 | 3/1995 |
| WO | WO 00/26354 | 5/2000 |
| WO | WO 01/36001 | 5/2001 |
| WO | WO 02/081507 | 10/2002 |
| WO | WO 03/066859 A2 | 8/2003 |
| WO | WO 03/075944 A2 | 9/2003 |
| WO | WO 2004/019856 A2 | 3/2004 |
| WO | WO 2004/022593 | 3/2004 |
| WO | WO 2004/022747 | 3/2004 |
| WO | WO 2004/031352 A2 * | 4/2004 |

OTHER PUBLICATIONS

Infergen from www.rxlist.com/cgi/generic/infergen.htm (enclosed).*

(Continued)

*Primary Examiner*—Cecilia Tsang
*Assistant Examiner*—Julie Ha
(74) *Attorney, Agent, or Firm*—Knobbe Martens Olson & Bear LLP

(57) ABSTRACT

The present invention provides synthetic Type I interferon receptor polypeptide agonists comprising consensus or hybrid Type I interferon receptor polypeptide agonists, containing one or more native or non-native glycosylation sites. The present invention provides synthetic Type I interferon receptor polypeptide agonists comprising consensus or hybrid Type I interferon receptor polypeptide agonists, containing one or more native or non-native glycosylation sites, as well as erythropoietin and darbepoetin alfa, each of which are linked to a penetrating peptide that facilitates translocation of a substance across a biological barrier as well as pharmaceutical compositions, including oral formulations, of the same. The present invention further provides oral formulations of hyperglycosylated or protease-resistant, hyperglycosylated polypeptide variants, which polypeptide variants lack at least one protease cleavage site found in a parent polypeptide, and thus exhibit increased protease resistance compared to the parent polypeptide, which polypeptide variants further include (1) a carbohydrate moiety covalently linked to at least one non-native glycosylation site not found in the parent protein therapeutic or (2) a carbohydrate moiety covalently linked to at least one native glycosylation site found but not glycosylated in the parent protein therapeutic. The present invention further provides compositions, including oral pharmaceutical compositions, comprising the synthetic Type I interferon receptor polypeptide agonist, the hyperglycosylated polypeptide variant, or the hyperglycosylated, protease-resistant polypeptide variant. The present invention further provides containers, devices, and kits comprising the synthetic Type I interferon receptor polypeptide agonist, the hyperglycosylated polypeptide variant, or the hyperglycosylated, protease-resistant polypeptide variant. The present invention further provides therapeutic methods involving administering an effective amount of an oral pharmaceutical composition comprising a synthetic Type I interferon receptor polypeptide agonist, a hyperglycosylated polypeptide variant, or a hyperglycosylated, protease-resistant polypeptide variant to an individual in need thereof.

27 Claims, 185 Drawing Sheets

U.S. PATENT DOCUMENTS

| | | |
|---|---|---|
| 4,959,455 A | 9/1990 | Clark et al. |
| 5,041,376 A | 8/1991 | Gething et al. |
| 5,122,469 A | 6/1992 | Mather et al. |
| 5,194,596 A | 3/1993 | Tischer et al. |
| 5,200,534 A | 4/1993 | Rao |
| 5,202,448 A | 4/1993 | Carver et al. |
| 5,229,529 A | 7/1993 | Ueno et al. |
| 5,240,848 A | 8/1993 | Keck et al. |
| 5,274,137 A | 12/1993 | Nicolaou et al. |
| 5,279,949 A | 1/1994 | Nair |
| 5,283,253 A | 2/1994 | Holton et al. |
| 5,294,637 A | 3/1994 | Chen et al. |
| 5,310,562 A | 5/1994 | Margolin |
| 5,332,671 A | 7/1994 | Ferrara et al. |
| 5,338,840 A | 8/1994 | Bayne et al. |
| 5,395,760 A | 3/1995 | Smith et al. |
| 5,415,869 A | 5/1995 | Straubinger et al. |
| 5,426,098 A | 6/1995 | Carlino |
| 5,462,925 A | 10/1995 | Ogawa et al. |
| 5,466,861 A | 11/1995 | Dawson et al. |
| 5,474,978 A | 12/1995 | Bakaysa et al. |
| 5,484,720 A | 1/1996 | Wurm et al. |
| 5,504,188 A | 4/1996 | Baker et al. |
| 5,514,646 A | 5/1996 | Chance et al. |
| 5,518,729 A | 5/1996 | Margolin |
| 5,520,911 A | 5/1996 | Anderson et al. |
| 5,521,184 A | 5/1996 | Zimmermann |
| 5,532,343 A | 7/1996 | Bayne et al. |
| 5,547,929 A | 8/1996 | Anderson, Jr. et al. |
| 5,559,101 A | 9/1996 | Weis et al. |
| 5,571,714 A | 11/1996 | Dasch et al. |
| 5,593,875 A | 1/1997 | Wurm et al. |
| 5,605,690 A | 2/1997 | Jacobs et al. |
| 5,631,015 A | 5/1997 | Bezwada et al. |
| 5,643,575 A | 7/1997 | Martinez et al. |
| 5,650,486 A | 7/1997 | De Felippis |
| 5,672,662 A | 9/1997 | Harris et al. |
| 5,674,843 A | 10/1997 | Carlino |
| 5,688,666 A | 11/1997 | Bass et al. |
| 5,688,679 A | 11/1997 | Powell |
| 5,690,925 A | 11/1997 | Gray et al. |
| 5,693,609 A | 12/1997 | Baker et al. |
| 5,700,862 A | 12/1997 | Chance et al. |
| 5,712,113 A | 1/1998 | Chung et al. |
| 5,716,632 A | 2/1998 | Margolin |
| 5,726,152 A | 3/1998 | Bayne et al. |
| 5,728,074 A | 3/1998 | Castellano et al. |
| 5,728,377 A | 3/1998 | Sarris et al. |
| 5,736,371 A | 4/1998 | Samain et al. |
| 5,747,642 A | 5/1998 | De Felippis |
| 5,759,807 A | 6/1998 | Breece et al. |
| 5,770,378 A | 6/1998 | Hwang et al. |
| 5,770,382 A | 6/1998 | Hwang et al. |
| 5,770,383 A | 6/1998 | Hwang et al. |
| 5,780,676 A | 7/1998 | Boehm et al. |
| 5,783,185 A | 7/1998 | Dasch et al. |
| 5,811,395 A | 9/1998 | Schwabe et al. |
| 5,821,263 A | 10/1998 | Scola et al. |
| 5,824,685 A | 10/1998 | Campochiaro et al. |
| 5,824,701 A | 10/1998 | Greenwald et al. |
| 5,853,724 A | 12/1998 | Garrity et al. |
| 5,869,680 A | 2/1999 | Mas et al. |
| 5,889,144 A | 3/1999 | Alila et al. |
| 5,922,675 A | 7/1999 | Baker et al. |
| 5,935,567 A | 8/1999 | Leder et al. |
| 5,945,402 A | 8/1999 | Cipolla et al. |
| 5,952,297 A | 9/1999 | De Felippis et al. |
| 5,965,697 A | 10/1999 | Czaplewski et al. |
| 5,985,265 A | 11/1999 | Kinstler et al. |
| 6,022,711 A | 2/2000 | Cunningham et al. |
| 6,034,054 A | 3/2000 | DeFelippis et al. |
| 6,046,305 A | 4/2000 | Choi |
| 6,057,428 A | 5/2000 | Keyt et al. |
| 6,090,822 A | 7/2000 | Margolin |
| 6,096,010 A | 8/2000 | Walters et al. |
| 6,100,071 A | 8/2000 | Davis-Smyth et al. |
| 6,127,332 A | 10/2000 | Goelz et al. |
| 6,132,970 A | 10/2000 | Stemmer |
| 6,136,563 A | 10/2000 | Cunningham et al. |
| 6,143,523 A | 11/2000 | Cunningham et al. |
| 6,143,715 A | 11/2000 | Llinas-Brunet et al. |
| 6,146,361 A | 11/2000 | DiBiasi et al. |
| 6,153,600 A | 11/2000 | Leder et al. |
| 6,168,784 B1 | 1/2001 | Offord et al. |
| 6,187,330 B1 | 2/2001 | Wang et al. |
| 6,200,953 B1 | 3/2001 | Schwabe et al. |
| 6,211,144 B1 | 4/2001 | Havelund |
| 6,214,542 B1 | 4/2001 | Striker et al. |
| 6,214,854 B1 | 4/2001 | Wang et al. |
| 6,221,053 B1 | 4/2001 | Walters et al. |
| 6,248,095 B1 | 6/2001 | Giambattista et al. |
| 6,265,380 B1 | 7/2001 | Tung et al. |
| 6,277,830 B1 | 8/2001 | Ganguly et al. |
| 6,288,089 B1 | 9/2001 | Zawada et al. |
| 6,296,842 B1 | 10/2001 | Jaworowicz et al. |
| 6,299,877 B1 | 10/2001 | Chen et al. |
| 6,300,475 B1 | 10/2001 | Chen et al. |
| 6,303,148 B1 | 10/2001 | Hennink et al. |
| 6,319,921 B1 | 11/2001 | Cirillo et al. |
| 6,323,180 B1 | 11/2001 | Llinas-Brunet et al. |
| 6,329,379 B1 | 12/2001 | Llinas-Brunet et al. |
| 6,329,417 B1 | 12/2001 | Llinas-Brunet et al. |
| 6,346,269 B1 | 2/2002 | Hsiao et al. |
| 6,348,444 B1 | 2/2002 | Chappel |
| 6,365,157 B2 | 4/2002 | Rockwell et al. |
| 6,375,929 B1 | 4/2002 | Thomas, Jr. et al. |
| 6,379,701 B1 | 4/2002 | Tracy et al. |
| 6,383,486 B1 | 5/2002 | Davis-Smyth et al. |
| 6,387,879 B1 | 5/2002 | Blume et al. |
| 6,410,531 B1 | 6/2002 | Llinas-Brunet et al. |
| 6,420,380 B2 | 7/2002 | Llinas-Brunet et al. |
| 6,423,695 B1 | 7/2002 | Tam et al. |
| 6,432,962 B2 | 8/2002 | Horneman |
| 6,440,985 B1 | 8/2002 | Bailey et al. |
| 6,448,077 B1 | 9/2002 | Rockwell et al. |
| 6,458,398 B1 | 10/2002 | Smith et al. |
| 6,475,796 B1 | 11/2002 | Pollitt et al. |
| 6,479,508 B1 | 11/2002 | Beaulieu et al. |
| 6,485,942 B1 | 11/2002 | Zioncheck et al. |
| 6,489,325 B1 | 12/2002 | Adams et al. |
| 6,491,906 B1 | 12/2002 | Strieter et al. |
| 6,497,871 B1 | 12/2002 | Gray et al. |
| 6,531,122 B1 | 3/2003 | Pedersen et al. |
| 6,534,523 B1 | 3/2003 | Llinas-Brunet et al. |
| 6,548,520 B1 | 4/2003 | Adams et al. |
| 6,569,420 B2 | 5/2003 | Chen et al. |
| 6,569,871 B1 | 5/2003 | Adams et al. |
| 6,585,398 B1 | 7/2003 | Haddad |
| 6,586,398 B1 | 7/2003 | Kinstler et al. |
| 6,608,027 B1 | 8/2003 | Tsantrizos et al. |
| 6,608,067 B1 | 8/2003 | Tung et al. |
| 6,608,182 B1 | 8/2003 | Rosen et al. |
| 6,617,160 B1 | 9/2003 | Shitara et al. |
| 6,617,309 B2 | 9/2003 | Tung et al. |
| 6,624,290 B2 | 9/2003 | Zhang |
| 6,630,155 B1 | 10/2003 | Chandrashekar et al. |
| 6,642,204 B2 | 11/2003 | Llinas-Brunet et al. |
| 6,646,110 B2 | 11/2003 | Nissen et al. |
| 6,673,580 B2 | 1/2004 | Koren et al. |
| 6,685,933 B1 | 2/2004 | Zoon et al. |
| 6,696,056 B1 | 2/2004 | Cheung et al. |
| 6,703,037 B1 | 3/2004 | Hubbell et al. |
| 6,703,225 B1 | 3/2004 | Kojima et al. |
| 6,709,649 B1 | 3/2004 | Lusso et al. |

| | | | |
|---|---|---|---|
| 6,730,303 | B1 | 5/2004 | Feng et al. |
| 2001/0036955 | A1 | 11/2001 | Gerritsen et al. |
| 2002/0058635 | A1 | 5/2002 | Averett |
| 2002/0156023 | A1 | 10/2002 | Walling et al. |
| 2002/0183364 | A1 | 12/2002 | Tang |
| 2003/0064069 | A1 | 4/2003 | Thompson et al. |
| 2003/0073832 | A1 | 4/2003 | Havez |
| 2003/0091566 | A1 | 5/2003 | Thompson et al. |
| 2003/0133907 | A1 | 7/2003 | Van Den Hazel et al. |
| 2003/0149041 | A1 | 8/2003 | Erickson et al. |
| 2003/0153046 | A1 | 8/2003 | Jensen et al. |
| 2003/0186895 | A1 | 10/2003 | Llinas-Brunet et al. |
| 2003/0187018 | A1 | 10/2003 | Llinas-Brunet et al. |
| 2004/0023869 | A1 | 2/2004 | Sims et al. |
| 2004/0132977 | A1 | 7/2004 | Gantier et al. |
| 2006/0182716 | A1 | 8/2006 | Hong et al. |

OTHER PUBLICATIONS

Infergen from www.drugdigest.org/DD/DVH/Uses/0,3915,891|Infergen,00.html (enclosed).*
NCBI Accession No. CAA80408.*
Loutfy MR, Blatt LM, Siminovitch KA, Ward S, Wolff B, Lho H, Pham DH, Deif H, LaMere EA, Chang M, Kain KC, Farcas GA, Ferguson P, Latchford M, Levy G, Dennis JW, Lai EKY, Fish EN, Interferon ALfacon-1 Plus Corticosteroids in Severe Acute Respriatory Syndrome, JAMA, 2003, 290(24): 3222-3228.*
Keating MR, Antiviral Agents for Non-Human Immunodeficiency VIrus Infections, Mayo CLinic Proceeding, 1999, 74: 1226-1283 (as enclosed, pp. 1-26).*
Nyman TA, Tolo H, Parkkinen J, Kalkkinen N, Identification of nine interferon-a subtypes produced by Sendai virus-induced human peripheral blood leucocytes, Biochem J., 1998, 329: 295-302.*
GenBank Accession # NP_002163.*
GenBank Accession No. NP_990758. Accessed Jul. 30, 2008.*
GenBank Accession No. AAB27160. Accessed Jul. 30, 2008.*
Egrie and Brown, Br J Cancer. Apr. 2001;84 Suppl 1:3-10.
Nyman et al. (1998) *Eur. J. Biochem.* 253:485-493.
Runkel et al. (1998) *Pharmaceutical Research* 15:641.
Adolf et al. (1990) *J. Biol. Chem.* 265:9290-9295.
International Search Report dated Nov. 23, 2007 for PCT/US2007/003333.
Written Opinion of the International Searching Authority dated Nov. 23, 2007 for PCT/US2007/003333.
Office Action dated Jun. 20, 2008 for U.S. Appl. No. 11/330,917, Filed Jan. 11, 2006.
International Search Report and Written Opinion dated Aug. 22, 2006 for International Application No. PCT/US2005/028165, Filed Aug. 8, 2005.
International Preliminary Report on Patentability dated Feb. 13, 2007 for International Application No. PCT/US2005/028165, Filed Aug. 8, 2005.
International Search Report and Written Opinion (Corrected Version) dated Oct. 26, 2007 for International Application No. PCT/US2007/003333, Filed Feb. 7, 2007.
International Preliminary Report on Patentability dated Aug. 8, 2008 for PCT/US2007/003333, Filed Feb. 7, 2007.

* cited by examiner

Figure 1 amino acid sequence of mature human IFN-α2a

```
Cys Asp Leu Pro Gln Thr His Ser Leu Gly Ser Arg Arg Thr Leu Met
1               5                   10                  15
Leu Leu Ala Gln Met Arg Lys Ile Ser Leu Phe Ser Cys Leu Lys Asp
            20                  25                  30
Arg His Asp Phe Gly Phe Pro Gln Glu Glu Phe Gly Asn Gln Phe Gln
            35                  40                  45
Lys Ala Glu Thr Ile Pro Val Leu His Glu Met Ile Gln Gln Ile Phe
            50                  55                  60
Asn Leu Phe Ser Thr Lys Asp Ser Ser Ala Ala Trp Asp Glu Thr Leu
65                  70                  75                  80
Leu Asp Lys Phe Tyr Thr Glu Leu Tyr Gln Gln Leu Asn Asp Leu Glu
            85                  90                  95
Ala Cys Val Ile Gln Gly Val Gly Val Thr Glu Thr Pro Leu Met Lys
            100                 105                 110
Glu Asp Ser Ile Leu Ala Val Arg Lys Tyr Phe Gln Arg Ile Thr Leu
            115                 120                 125
Tyr Leu Lys Glu Lys Lys Tyr Ser Pro Cys Ala Trp Glu Val Val Arg
    130                 135                 140
Ala Glu Ile Met Arg Ser Phe Ser Leu Ser Thr Asn Leu Gln Glu Ser
145                 150                 155                 160
Leu Arg Ser Lys Glu
            165
```

Figure 2 amino acid sequence of mature, human IFN-α2b

```
Cys Asp Leu Pro Gln Thr His Ser Leu Gly Ser Arg Arg Thr Leu Met
1               5                   10                  15
Leu Leu Ala Gln Met Arg Arg Ile Ser Leu Phe Ser Cys Leu Lys Asp
            20                  25                  30
Arg His Asp Phe Gly Phe Pro Gln Glu Glu Phe Gly Asn Gln Phe Gln
            35                  40                  45
Lys Ala Glu Thr Ile Pro Val Leu His Glu Met Ile Gln Gln Ile Phe
    50                  55                  60
Asn Leu Phe Ser Thr Lys Asp Ser Ser Ala Ala Trp Asp Glu Thr Leu
65                  70                  75                  80
Leu Asp Lys Phe Tyr Thr Glu Leu Tyr Gln Gln Leu Asn Asp Leu Glu
                85                  90                  95
Ala Cys Val Ile Gln Gly Val Gly Val Thr Glu Thr Pro Leu Met Lys
                100                 105                 110
Glu Asp Ser Ile Leu Ala Val Arg Lys Tyr Phe Gln Arg Ile Thr Leu
            115                 120                 125
Tyr Leu Lys Glu Lys Lys Tyr Ser Pro Cys Ala Trp Glu Val Val Arg
    130                 135                 140
Ala Glu Ile Met Arg Ser Phe Ser Leu Ser Thr Asn Leu Gln Glu Ser
145                 150                 155                 160
Leu Arg Ser Lys Glu
                165
```

Figure 3 amino acid sequence of human IFN-β

```
Met Ser Tyr Asn Leu Leu Gly Phe Leu Gln Arg Ser Ser Asn Phe Gln
1           5                   10              15
Cys Gln Lys Leu Leu Trp Gln Leu Asn Gly Arg Leu Glu Tyr Cys Leu
            20                  25              30
Lys Asp Arg Met Asn Phe Asp Ile Pro Glu Glu Ile Lys Gln Leu Gln
            35              40              45
Gln Phe Gln Lys Glu Asp Ala Ala Leu Thr Ile Tyr Glu Met Leu Gln
    50              55              60
Asn Ile Phe Ala Ile Phe Arg Gln Asp Ser Ser Ser Thr Gly Trp Asn
65              70              75              80
Glu Thr Ile Val Glu Asn Leu Leu Ala Asn Val Tyr His Gln Ile Asn
                85              90              95
His Leu Lys Thr Val Leu Glu Glu Lys Leu Glu Lys Glu Asp Phe Thr
            100             105             110
Arg Gly Lys Leu Met Ser Ser Leu His Leu Lys Arg Tyr Tyr Gly Arg
            115             120             125
Ile Leu His Tyr Leu Lys Ala Lys Glu Tyr Ser His Cys Ala Trp Thr
        130             135             140
Ile Val Arg Val Glu Ile Leu Arg Asn Phe Tyr Phe Ile Asn Arg Leu
145             150             155             160
Thr Gly Tyr Leu Arg Asn
                165
```

Figure 4 human IFN-γ amino acid sequence

```
Cys Tyr Cys Gln Asp Pro Tyr Val Lys Glu Ala Glu Asn Leu Lys Lys
 1            5                  10                    15
Tyr Phe Asn Ala Gly His Ser Asp Val Ala Asp Asn Gly Thr Leu Phe
            20                  25                  30
Leu Gly Ile Leu Lys Asn Trp Lys Glu Glu Ser Asp Arg Lys Ile Met
            35                  40                  45
Gln Ser Gln Ile Val Ser Phe Tyr Phe Lys Leu Phe Lys Asn Phe Lys
    50                  55                  60
Asp Asp Gln Ser Ile Gln Lys Ser Val Glu Thr Ile Lys Glu Asp Met
65                  70                  75                  80
Asn Val Lys Phe Phe Asn Ser Asn Lys Lys Lys Arg Asp Asp Phe Glu
            85                  90                  95
Lys Leu Thr Asn Tyr Ser Val Thr Asp Leu Asn Val Gln Arg Lys Ala
            100                 105                 110
Ile His Glu Leu Ile Gln Val Met Ala Glu Leu Ser Pro Ala Ala Lys
            115                 120                 125
Thr Gly Lys Arg Lys Arg Ser Gln Met Leu Phe Arg Gly Arg Arg Ala
    130                 135                 140
Ser Gln
145
```

Figure 5 amino acid sequence of mature, human G-CSF

```
Thr Pro Leu Gly Pro Ala Ser Ser Leu Pro Gln Ser Phe Leu Leu Lys
 1           5                   10                  15
Cys Leu Glu Gln Val Arg Lys Ile Gln Gly Asp Gly Ala Ala Leu Gln
            20                  25                  30
Glu Lys Leu Val Ser Glu Cys Ala Thr Tyr Lys Leu Cys His Pro Glu
            35                  40                  45
Glu Leu Val Leu Leu Gly His Ser Leu Gly Ile Pro Trp Ala Pro Leu
            50                  55                  60
Ser Ser Cys Pro Ser Gln Ala Leu Gln Leu Ala Gly Cys Leu Ser Gln
65                  70                  75                  80
Leu His Ser Gly Leu Phe Leu Tyr Gln Gly Leu Leu Gln Ala Leu Glu
            85                  90                  95
Gly Ile Ser Pro Glu Leu Gly Pro Thr Leu Asp Thr Leu Gln Leu Asp
            100                 105                 110
Val Ala Asp Phe Ala Thr Thr Ile Trp Gln Gln Met Glu Glu Leu Gly
            115                 120                 125
Met Ala Pro Ala Leu Gln Pro Thr Gln Gly Ala Met Pro Ala Phe Ala
            130                 135                 140
Ser Ala Phe Gln Arg Arg Ala Gly Gly Val Leu Val Ala Ser His Leu
145                 150                 155                 160
Gln Ser Phe Leu Glu Val Ser Tyr Arg Val Leu Arg His Leu Ala Gln
            165                 170                 175
Pro
```

Figure 6 amino acid sequence of human growth hormone

```
Phe Pro Thr Ile Pro Leu Ser Arg Leu Phe Asp Asn Ala Met Leu Arg
 1           5                   10                  15
Ala Arg Arg Leu Tyr Gln Leu Ala Tyr Asp Thr Tyr Gln Glu Phe Glu
            20                  25                  30
Glu Ala Tyr Ile Leu Lys Glu Gln Lys Tyr Ser Phe Leu Gln Asn Pro
            35                  40                  45
Gln Thr Ser Leu Cys Phe Ser Glu Ser Ile Pro Thr Pro Ser Asn Arg
    50                  55                  60
Glu Glu Thr Gln Gln Lys Ser Asn Leu Glu Leu Leu Arg Ile Ser Leu
65                  70                  75                  80
Leu Leu Ile Gln Ser Trp Leu Glu Pro Val Gln Phe Leu Arg Ser Val
            85                  90                  95
Phe Ala Asn Ser Leu Val Tyr Gly Ala Ser Asp Ser Asn Val Tyr Asp
            100                 105                 110
Leu Leu Lys Asp Leu Glu Glu Gly Ile Gln Thr Leu Met Gly Arg Leu
        115                 120                 125
Glu Asp Gly Ser Pro Arg Thr Gly Gln Ile Phe Lys Gln Thr Tyr Ser
    130                 135                 140
Lys Phe Asp Thr Asn Ser His Asn Asp Asp Ala Leu Leu Lys Asn Tyr
145                 150                 155                 160
Gly Leu Leu Tyr Cys Phe Arg Lys Asp Met Asp Lys Val Glu Thr Phe
            165                 170                 175
Leu Arg Ile Val Gln Cys Arg Ser Val Glu Gly Ser Cys Gly Phe
            180                 185                 190
```

Figure 7 amino acid sequence of human erythropoietin

```
Ala Pro Pro Arg Leu Ile Cys Asp Ser Arg Val Leu Glu Arg Tyr Leu
1               5                   10                  15
Leu Glu Ala Lys Glu Ala Glu Asn Ile Thr Thr Gly Cys Ala Glu His
            20              25                  30
Cys Ser Leu Asn Glu Asn Ile Thr Val Pro Asp Thr Lys Val Asn Phe
            35              40                  45
Tyr Ala Trp Lys Arg Met Glu Val Gly Gln Gln Ala Val Glu Val Trp
    50              55                  60
Gln Gly Leu Ala Leu Leu Ser Glu Ala Val Leu Arg Gly Gln Ala Leu
65              70                  75                      80
Leu Val Asn Ser Ser Gln Pro Trp Glu Pro Leu Gln Leu His Val Asp
                85              90                      95
Lys Ala Val Ser Gly Leu Arg Ser Leu Thr Thr Leu Leu Arg Ala Leu
            100             105                 110
Gly Ala Gln Lys Glu Ala Ile Ser Pro Pro Asp Ala Ala Ser Ala Ala
        115             120                 125
Pro Leu Arg Thr Ile Thr Ala Asp Thr Phe Arg Lys Leu Phe Arg Val
    130             135                 140
Tyr Ser Asn Phe Leu Arg Gly Lys Leu Lys Leu Tyr Thr Gly Glu Ala
145             150                 155                     160
Cys Arg Thr Gly Asp Arg
                165
```

Figure 8 amino acid sequence of human GM-CSF

```
Ala  Pro  Ala  Arg  Ser  Pro  Ser  Pro  Ser  Thr  Gln  Pro  Trp  Glu  His  Val
1              5                        10                       15
Asn  Ala  Ile  Gln  Glu  Ala  Arg  Arg  Leu  Leu  Asn  Leu  Ser  Arg  Asp  Thr
               20                       25                       30
Ala  Ala  Glu  Met  Asn  Glu  Thr  Val  Glu  Val  Ile  Ser  Glu  Met  Phe  Asp
               35                       40                       45
Leu  Gln  Glu  Pro  Thr  Cys  Leu  Gln  Thr  Arg  Leu  Glu  Leu  Tyr  Lys  Gln
          50                       55                       60
Gly  Leu  Arg  Gly  Ser  Leu  Thr  Lys  Leu  Lys  Gly  Pro  Leu  Thr  Met  Met
65                       70                       75                       80
Ala  Ser  His  Tyr  Lys  Gln  His  Cys  Pro  Pro  Thr  Pro  Glu  Thr  Ser  Cys
               85                       90                       95
Ala  Thr  Gln  Ile  Ile  Thr  Phe  Glu  Ser  Phe  Lys  Glu  Asn  Leu  Lys  Asp
               100                      105                      110
Phe  Leu  Leu  Val  Ile  Pro  Phe  Asp  Cys  Trp  Glu  Pro  Val  Gln  Glu  Glu
               115                      120                      125
```

Figure 9

Amino acid sequence of consensus IFN-a

```
Cys Asp Leu Pro Gln Thr His Ser Leu Gly Asn Arg Arg Ala Leu Ile
 1           5                  10                 15
Leu Leu Ala Gln Met Arg Arg Ile Ser Pro Phe Ser Cys Leu Lys Asp
            20                  25                 30
Arg His Asp Phe Gly Phe Pro Gln Glu Glu Phe Asp Gly Asn Gln Phe
            35                  40                 45
Gln Lys Ala Gln Ala Ile Ser Val Leu His Glu Met Ile Gln Gln Thr
            50                  55                 60
Phe Asn Leu Phe Ser Thr Lys Asp Ser Ser Ala Ala Trp Asp Glu Ser
65                  70                  75                 80
Leu Leu Glu Lys Phe Tyr Thr Glu Leu Tyr Gln Gln Leu Asn Asp Leu
            85                  90                 95
Glu Ala Cys Val Ile Gln Glu Val Gly Val Glu Glu Thr Pro Leu Met
            100                 105                110
Asn Val Asp Ser Ile Leu Ala Val Lys Lys Tyr Phe Gln Arg Ile Thr
            115                 120                125
Leu Tyr Leu Thr Glu Lys Lys Tyr Ser Pro Cys Ala Trp Glu Val Val
    130                 135                140
Arg Ala Glu Ile Met Arg Ser Phe Ser Leu Ser Thr Asn Leu Gln Glu
145                 150                 155                160
Arg Leu Arg Arg Lys Glu
            165
```

Figure 10 amino acid sequence of human IFN-αc

```
Cys Asp Leu Pro Gln Thr His Ser Leu Gly Asn Arg Arg Ala Leu Ile
 1               5                  10                  15
Leu Leu Gly Gln Met Gly Arg Ile Ser Pro Phe Ser Cys Leu Lys Asp
            20                  25                  30
Arg His Asp Phe Arg Ile Pro Gln Glu Glu Phe Asp Gly Asn Gln Phe
        35                  40                  45
Gln Lys Ala Gln Ala Ile Ser Val Leu His Glu Met Ile Gln Gln Thr
    50                  55                  60
Phe Asn Leu Phe Ser Thr Glu Asp Ser Ser Ala Ala Trp Glu Gln Ser
65                  70                  75                  80
Leu Leu Glu Lys Phe Ser Thr Glu Leu Tyr Gln Gln Leu Asn Asp Leu
            85                  90                  95
Glu Ala Cys Val Ile Gln Glu Val Gly Val Glu Glu Thr Pro Leu Met
            100                 105                 110
Asn Glu Asp Ser Ile Leu Ala Val Arg Lys Tyr Phe Gln Arg Ile Thr
        115                 120                 125
Leu Tyr Leu Ile Glu Arg Lys Tyr Ser Pro Cys Ala Trp Glu Val Val
    130                 135                 140
Arg Ala Glu Ile Met Arg Ser Leu Ser Phe Ser Thr Asn Leu Gln Lys
145                 150                 155                 160
Arg Leu Arg Arg Lys Asp
            165
```

Figure 11 amino acid sequence of IFN-α2c

```
Cys Asp Leu Pro Gln Thr His Ser Leu Gly Ser Arg Arg Thr Leu Met
 1               5                  10                 15
Leu Leu Ala Gln Met Arg Arg Ile Ser Leu Phe Ser Cys Leu Lys Asp
            20                 25                 30
Arg Arg Asp Phe Gly Phe Pro Gln Glu Glu Phe Gly Asn Gln Phe Gln
            35                 40                 45
Lys Ala Glu Thr Ile Pro Val Leu His Glu Met Ile Gln Gln Ile Phe
            50                 55                 60
Asn Leu Phe Ser Thr Lys Asp Ser Ser Ala Ala Trp Asp Glu Thr Leu
 65                 70                 75                 80
Leu Asp Lys Phe Tyr Thr Glu Leu Tyr Gln Gln Leu Asn Asp Leu Glu
                85                 90                 95
Ala Cys Val Ile Gln Gly Val Gly Val Thr Glu Thr Pro Leu Met Lys
                100                105                110
Glu Asp Ser Ile Leu Ala Val Arg Lys Tyr Phe Gln Arg Ile Thr Leu
            115                120                125
Tyr Leu Lys Glu Lys Lys Tyr Ser Pro Cys Ala Trp Glu Val Val Arg
    130                135                140
Ala Glu Ile Met Arg Ser Phe Ser Leu Ser Thr Asn Leu Gln Glu Ser
145                 150                155                160
Leu Arg Ser Lys Glu
                165
```

Figure 12 amino acid sequence of IFN-αd

```
Cys Asp Leu Pro Glu Thr His Ser Leu Asp Asn Arg Arg Thr Leu Met
 1           5                   10                  15
Leu Leu Ala Gln Met Ser Arg Ile Ser Pro Ser Ser Cys Leu Met Asp
            20                  25                  30
Arg His Asp Phe Gly Phe Pro Gln Glu Glu Phe Asp Gly Asn Gln Phe
            35                  40                  45
Gln Lys Ala Pro Ala Ile Ser Val Leu His Glu Leu Ile Gln Gln Ile
 50                      55                  60
Phe Asn Leu Phe Thr Thr Lys Asp Ser Ser Ala Ala Trp Asp Glu Asp
 65                 70                  75                  80
Leu Leu Asp Lys Phe Cys Thr Glu Leu Tyr Gln Gln Leu Asn Asp Leu
                    85                  90                  95
Glu Ala Cys Val Met Gln Glu Glu Arg Val Gly Glu Thr Pro Leu Met
                100                 105                 110
Asn Ala Asp Ser Ile Leu Ala Val Lys Lys Tyr Phe Arg Arg Ile Thr
            115                 120                 125
Leu Tyr Leu Thr Glu Lys Lys Tyr Ser Pro Cys Ala Trp Glu Val Val
 130                     135                 140
Arg Ala Glu Ile Met Arg Ser Leu Ser Leu Ser Thr Asn Leu Gln Glu
 145                150                 155                 160
Arg Leu Arg Arg Lys Glu
                165
```

Figure 13 amino acid sequence of IFN-α5

```
Cys Asp Leu Pro Gln Thr His Ser Leu Ser Asn Arg Arg Thr Leu Met
1           5                   10                  15
Ile Met Ala Gln Met Gly Arg Ile Ser Pro Phe Ser Cys Leu Lys Asp
            20                  25                  30
Arg His Asp Phe Gly Phe Pro Gln Glu Glu Phe Asp Gly Asn Gln Phe
            35                  40                  45
Gln Lys Ala Gln Ala Ile Ser Val Leu His Glu Met Ile Gln Gln Thr
    50                  55                  60
Phe Asn Leu Phe Ser Thr Lys Asp Ser Ser Ala Thr Trp Asp Glu Thr
65                  70                  75                  80
Leu Leu Asp Lys Phe Tyr Thr Glu Leu Tyr Gln Gln Leu Asn Asp Leu
                85                  90                  95
Glu Ala Cys Met Met Gln Glu Val Gly Val Glu Asp Thr Pro Leu Met
            100                 105                 110
Asn Val Asp Ser Ile Leu Thr Val Arg Lys Tyr Phe Gln Arg Ile Thr
            115                 120                 125
Leu Tyr Leu Thr Glu Lys Lys Tyr Ser Pro Cys Ala Trp Glu Val Val
    130                 135                 140
Arg Ala Glu Ile Met Arg Ser Phe Ser Leu Ser Ala Asn Leu Gln Glu
145                 150                 155                 160
Arg Leu Arg Arg Lys Glu
            165
```

Figure 14 amino acid sequence of IFN-α6

```
Cys Asp Leu Pro Gln Thr His Ser Leu Gly His Arg Arg Thr Met Met
 1           5                   10                  15
Leu Leu Ala Gln Met Arg Arg Ile Ser Leu Phe Ser Cys Leu Lys Asp
         20                  25                  30
Arg His Asp Phe Arg Phe Pro Gln Glu Glu Phe Asp Gly Asn Gln Phe
         35                  40                  45
Gln Lys Ala Glu Ala Ile Ser Val Leu His Glu Val Ile Gln Gln Thr
     50                  55                  60
Phe Asn Leu Phe Ser Thr Lys Asp Ser Ser Val Ala Trp Asp Glu Arg
 65                  70                  75                  80
Leu Leu Asp Lys Leu Tyr Thr Glu Leu Tyr Gln Gln Leu Asn Asp Leu
             85                  90                  95
Glu Ala Cys Val Met Gln Glu Val Trp Val Gly Gly Thr Pro Leu Met
            100                 105                 110
Asn Glu Asp Ser Ile Leu Ala Val Arg Lys Tyr Phe Gln Arg Ile Thr
        115                 120                 125
Leu Tyr Leu Thr Glu Lys Lys Tyr Ser Pro Cys Ala Trp Glu Val Val
    130                 135                 140
Arg Ala Glu Ile Met Arg Ser Phe Ser Ser Ser Arg Asn Leu Gln Glu
145                 150                 155                 160
Arg Leu Arg Arg Lys Glu
                165
```

Figure 15 amino acid sequence of IFN-α4

```
Cys Asp Leu Pro Gln Thr His Ser Leu Gly Asn Arg Arg Ala Leu Ile
 1           5                   10                  15
Leu Leu Ala Gln Met Gly Arg Ile Ser His Phe Ser Cys Leu Lys Asp
            20                  25                  30
Arg His Asp Phe Gly Phe Pro Glu Glu Phe Asp Gly His Gln Phe
            35                  40                  45
Gln Lys Ala Gln Ala Ile Ser Val Leu His Glu Met Ile Gln Gln Thr
    50                  55                  60
Phe Asn Leu Phe Ser Thr Glu Asp Ser Ser Ala Ala Trp Glu Gln Ser
65                  70                  75                  80
Leu Leu Glu Lys Phe Ser Thr Glu Leu Tyr Gln Gln Leu Asn Asp Leu
            85                  90                  95
Glu Ala Cys Val Ile Gln Glu Val Gly Val Glu Glu Thr Pro Leu Met
            100                 105                 110
Asn Glu Asp Ser Ile Leu Ala Val Arg Lys Tyr Phe Gln Arg Ile Thr
            115                 120                 125
Leu Tyr Leu Thr Glu Lys Lys Tyr Ser Pro Cys Ala Trp Glu Val Val
    130                 135                 140
Arg Ala Glu Ile Met Arg Ser Leu Ser Phe Ser Thr Asn Leu Gln Lys
145                 150                 155                 160
Arg Leu Arg Arg Lys Asp
                165
```

Figure 16 amino acid sequence of IFN-α4b

```
Cys Asp Leu Pro Gln Thr His Ser Leu Gly Asn Arg Arg Ala Leu Ile
1               5                   10                  15
Leu Leu Ala Gln Met Gly Arg Ile Ser His Phe Ser Cys Leu Lys Asp
            20                  25                  30
Arg His Asp Phe Gly Phe Pro Glu Glu Glu Phe Asp Gly His Gln Phe
        35                  40                  45
Gln Lys Thr Gln Ala Ile Ser Val Leu His Glu Met Ile Gln Gln Thr
    50                  55                  60
Phe Asn Leu Phe Ser Thr Glu Asp Ser Ser Ala Ala Trp Glu Gln Ser
65                  70                  75                  80
Leu Leu Glu Lys Phe Ser Thr Glu Leu Tyr Gln Gln Leu Asn Asp Leu
            85                  90                  95
Glu Ala Cys Val Ile Gln Glu Val Gly Val Glu Glu Thr Pro Leu Met
            100                 105                 110
Asn Val Asp Ser Ile Leu Ala Val Arg Lys Tyr Phe Gln Arg Ile Thr
            115                 120                 125
Leu Tyr Leu Thr Glu Lys Lys Tyr Ser Pro Cys Ala Trp Glu Val Val
    130                 135                 140
Arg Ala Glu Ile Met Arg Ser Leu Ser Phe Ser Thr Asn Leu Gln Lys
145                 150                 155                 160
Arg Leu Arg Arg Lys Asp
                165
```

Figure 17 amino acid sequence of IFN-αI

```
Cys Asp Leu Pro Gln Thr His Ser Leu Gly Asn Arg Arg Ala Leu Ile
 1               5                  10                  15
Leu Leu Ala Gln Met Gly Arg Ile Ser Pro Phe Ser Cys Leu Lys Asp
            20                  25                  30
Arg His Asp Phe Gly Leu Pro Gln Glu Glu Phe Asp Gly Asn Gln Phe
            35                  40                  45
Gln Lys Thr Gln Ala Ile Ser Val Leu His Glu Met Ile Gln Gln Thr
    50                  55                  60
Phe Asn Leu Phe Ser Thr Glu Asp Ser Ser Ala Ala Trp Glu Gln Ser
65                  70                  75                  80
Leu Leu Glu Lys Phe Ser Thr Glu Leu Tyr Gln Gln Leu Asn Asn Leu
            85                  90                  95
Glu Ala Cys Val Ile Gln Glu Val Gly Met Glu Glu Thr Pro Leu Met
            100                 105                 110
Asn Glu Asp Ser Ile Leu Ala Val Arg Lys Tyr Phe Gln Arg Ile Thr
        115                 120                 125
Leu Tyr Leu Thr Glu Lys Lys Tyr Ser Pro Cys Ala Trp Glu Val Val
    130                 135                 140
Arg Ala Glu Ile Met Arg Ser Leu Ser Phe Ser Thr Asn Leu Gln Lys
145                 150                 155                 160
Ile Leu Arg Arg Lys Asp
                165
```

Figure 18 amino acid sequence of IFN-αJ

```
Cys Asp Leu Pro Gln Thr His Ser Leu Arg Asn Arg Arg Ala Leu Ile
1               5                   10                  15
Leu Leu Ala Gln Met Gly Arg Ile Ser Pro Phe Ser Cys Leu Lys Asp
            20                  25                  30
Arg His Glu Phe Arg Phe Pro Glu Glu Glu Phe Asp Gly His Gln Phe
            35                  40                  45
Gln Lys Thr Gln Ala Ile Ser Val Leu His Glu Met Ile Gln Gln Thr
    50                  55                  60
Phe Asn Leu Phe Ser Thr Glu Asp Ser Ser Ala Ala Trp Glu Gln Ser
65                  70                  75                  80
Leu Leu Glu Lys Phe Ser Thr Glu Leu Tyr Gln Gln Leu Asn Asp Leu
                85                  90                  95
Glu Ala Cys Val Ile Gln Glu Val Gly Val Glu Glu Thr Pro Leu Met
            100                 105                 110
Asn Glu Asp Phe Ile Leu Ala Val Arg Lys Tyr Phe Gln Arg Ile Thr
            115                 120                 125
Leu Tyr Leu Met Glu Lys Lys Tyr Ser Pro Cys Ala Trp Glu Val Val
    130                 135                 140
Arg Ala Glu Ile Met Arg Ser Phe Ser Phe Ser Thr Asn Leu Lys Lys
145                 150                 155                 160
Gly Leu Arg Arg Lys Asp
                165
```

Figure 19 amino acid sequence of IFN-αH

```
Cys Asn Leu Ser Gln Thr His Ser Leu Asn Asn Arg Arg Thr Leu Met
 1            5                    10                  15
Leu Met Ala Gln Met Arg Arg Ile Ser Pro Phe Ser Cys Leu Lys Asp
            20                  25                  30
Arg His Asp Phe Glu Phe Pro Gln Glu Glu Phe Asp Gly Asn Gln Phe
        35                  40                  45
Gln Lys Ala Gln Ala Ile Ser Val Leu His Glu Met Met Gln Gln Thr
    50                  55                  60
Phe Asn Leu Phe Ser Thr Lys Asn Ser Ser Ala Ala Trp Asp Glu Thr
65                  70                  75                  80
Leu Leu Glu Lys Phe Tyr Ile Glu Leu Phe Gln Gln Met Asn Asp Leu
                85                  90                  95
Glu Ala Cys Val Ile Gln Glu Val Gly Val Glu Glu Thr Pro Leu Met
            100                 105                 110
Asn Glu Asp Ser Ile Leu Ala Val Lys Lys Tyr Phe Gln Arg Ile Thr
            115                 120                 125
Leu Tyr Leu Met Glu Lys Lys Tyr Ser Pro Cys Ala Trp Glu Val Val
    130                 135                 140
Arg Ala Glu Ile Met Arg Ser Leu Ser Phe Ser Thr Asn Leu Gln Lys
145                 150                 155                 160
Arg Leu Arg Arg Lys Asp
            165
```

Figure 20 amino acid sequence of IFN-αF

```
Cys Asp Leu Pro Gln Thr His Ser Leu Gly Asn Arg Arg Ala Leu Ile
1               5                   10                  15
Leu Leu Ala Gln Met Gly Arg Ile Ser Pro Phe Ser Cys Leu Lys Asp
            20                  25                  30
Arg His Asp Phe Gly Phe Pro Gln Glu Glu Phe Asp Gly Asn Gln Phe
                35                  40                  45
Gln Lys Ala Gln Ala Ile Ser Val Leu His Glu Met Ile Gln Gln Thr
        50                  55                  60
Phe Asn Leu Phe Ser Thr Lys Asp Ser Ser Ala Thr Trp Glu Gln Ser
65                  70                  75                  80
Leu Leu Glu Lys Phe Ser Thr Glu Leu Asn Gln Gln Leu Asn Asp Leu
                85                  90                  95
Glu Ala Cys Val Ile Gln Glu Val Gly Val Glu Glu Thr Pro Leu Met
                100                 105                 110
Asn Val Asp Ser Ile Leu Ala Val Lys Lys Tyr Phe Gln Arg Ile Thr
            115                 120                 125
Leu Tyr Leu Thr Glu Lys Lys Tyr Ser Pro Cys Ala Trp Glu Val Val
    130                 135                 140
Arg Ala Glu Ile Met Arg Ser Phe Ser Leu Ser Lys Ile Phe Gln Glu
145                 150                 155                 160
Arg Leu Arg Arg Lys Glu
                165
```

Figure 21 amino acid sequence of IFN-α8

```
Cys Asp Leu Pro Gln Thr His Ser Leu Gly Asn Arg Arg Ala Leu Ile
 1           5                   10                  15
Leu Leu Ala Gln Met Arg Arg Ile Ser Pro Phe Ser Cys Leu Lys Asp
            20                  25                  30
Arg His Asp Phe Glu Phe Pro Gln Glu Glu Phe Asp Asp Lys Gln Phe
            35                  40                  45
Gln Lys Ala Gln Ala Ile Ser Val Leu His Glu Met Ile Gln Gln Thr
        50                  55                  60
Phe Asn Leu Phe Ser Thr Lys Asp Ser Ser Ala Ala Leu Asp Glu Thr
65                  70                  75                  80
Leu Leu Asp Glu Phe Tyr Ile Glu Leu Asp Gln Gln Leu Asn Asp Leu
                85                  90                  95
Glu Ser Cys Val Met Gln Glu Val Gly Val Ile Glu Ser Pro Leu Met
            100                 105                 110
Tyr Glu Asp Ser Ile Leu Ala Val Arg Lys Tyr Phe Gln Arg Ile Thr
            115                 120                 125
Leu Tyr Leu Thr Glu Lys Lys Tyr Ser Ser Cys Ala Trp Glu Val Val
        130                 135                 140
Arg Ala Glu Ile Met Arg Ser Phe Ser Leu Ser Ile Asn Leu Gln Lys
145                 150                 155                 160
Arg Leu Lys Ser Lys Glu
                165
```

Figure 22 amino acid sequence of IFN-β1

```
Met Ser Tyr Asn Leu Leu Gly Phe Leu Gln Arg Ser Ser Asn Phe Gln
 1            5                   10                  15
Cys Gln Lys Leu Leu Trp Gln Leu Asn Gly Arg Leu Glu Tyr Cys Leu
            20                  25                  30
Lys Asp Arg Met Asn Phe Asp Ile Pro Glu Glu Ile Lys Gln Leu Gln
            35                  40                  45
Gln Phe Gln Lys Glu Asp Ala Ala Leu Thr Ile Tyr Glu Met Leu Gln
        50                  55                  60
Asn Ile Phe Ala Ile Phe Arg Gln Asp Ser Ser Ser Thr Gly Trp Asn
65                      70                  75                  80
Glu Thr Ile Val Glu Asn Leu Leu Ala Asn Val Tyr His Gln Ile Asn
                    85                  90                  95
His Leu Lys Thr Val Leu Glu Glu Lys Leu Glu Lys Glu Asp Phe Thr
                100                 105                 110
Arg Gly Lys Leu Met Ser Ser Leu His Leu Lys Arg Tyr Tyr Gly Arg
            115                 120                 125
Ile Leu His Tyr Leu Lys Ala Lys Glu Tyr Ser His Cys Ala Trp Thr
            130                 135                 140
Ile Val Arg Val Glu Ile Leu Arg Asn Phe Tyr Phe Ile Asn Arg Leu
145                 150                 155                 160
Thr Gly Tyr Leu Arg Asn
                165
```

Figure 23 amino acid sequence of IFN-β2a

```
Val Pro Pro Gly Glu Asp Ser Lys Asp Val Ala Ala Pro His Arg Gln
 1           5                   10                  15
Pro Leu Thr Ser Ser Glu Arg Ile Asp Lys Gln Ile Arg Tyr Ile Leu
             20                  25                  30
Asp Gly Ile Ser Ala Leu Arg Lys Glu Thr Cys Asn Lys Ser Asn Met
             35                  40                  45
Cys Glu Ser Ser Lys Glu Ala Leu Ala Glu Asn Asn Leu Asn Leu Pro
 50                      55                  60
Lys Met Ala Glu Lys Asp Gly Cys Phe Gln Ser Gly Phe Asn Glu Glu
65                   70                  75                  80
Thr Cys Leu Val Lys Ile Ile Thr Gly Leu Leu Glu Phe Glu Val Tyr
             85                  90                  95
Leu Glu Tyr Leu Gln Asn Arg Phe Glu Ser Ser Glu Glu Gln Ala Arg
             100                 105                 110
Ala Val Gln Met Ser Thr Lys Val Leu Ile Gln Phe Leu Gln Lys Lys
             115                 120                 125
Ala Lys Asn Leu Asp Ala Ile Thr Thr Pro Asp Pro Thr Thr Asn Ala
     130                 135                 140
Ser Leu Leu Thr Lys Leu Gln Ala Gln Asn Gln Trp Leu Gln Asp Met
145                  150                 155                 160
Thr Thr His Leu Ile Leu Arg Ser Phe Lys Glu Phe Leu Gln Ser Ser
             165                 170                 175
Leu Arg Ala Leu Arg Gln Met
             180
```

```
                                        Site 1          Site 2
                                          ▼               ▼
       M  I  Q  Q  T  F  N  L  F  S  T  K  D  S  S  A  A  W  D  E   Majority
                                       70                      80
  61   M  I  Q  Q  T  F  N  L  F  S  T  K  D  S  S  A  A  W  D  E   Infergen
  61   M  I  Q  Q  T  F  N  L  F  S  T  K [N] S  S  A  A  W  D  E   Infergen D73N
  61   M  I  Q  Q  T  F  N  L  F  S  T  K  D  S  S  A  A  W [N] E   Infergen D79N
  61   M  I  Q  Q  T  F  N  L  F  S  T  K  D  S  S  A  A  W  D  E   Infergen E108T
  61   M  I  Q  Q  T  F  N  L  F  S  T  K  D  S  S  A  A  W  D  E   Infergen E108N
  61   M  I  Q  Q  T  F  N  L  F  S  T  K [N] S  S  A  A  W [N] E   Infergen D73N_D79N
  61   M  I  Q  Q  T  F  N  L  F  S  T  K [N] S  S  A  A  W  D  E   Infergen D73N_E108T
  61   M  I  Q  Q  T  F  N  L  F  S  T  K  D  S  S  A  A  W [N] E   Infergen D79N_E108T
  61   M  I  Q  Q  T  F  N  L  F  S  T  K [N] S  S  A  A  W  D  E   Infergen D73N_E108N
  61   M  I  Q  Q  T  F  N  L  F  S  T  K  D  S  S  A  A  W  N  E   Infergen D79N_E108N
  61   M  I  Q  Q  T  F  N  L  F  S  T  K [N] S  S  A  A  W  N  E   Infergen D73N_D79N_E108T
  61   M  I  Q  Q  T  F  N  L  F  S  T  K [N] S  S  A  A  W [N] E   Infergen D73N_D79N_E108N S  L  L  E  K  F  Y  T  E  L  Y  Q  Q  L  N  D  L  E  A  C   Majority
                                       90                     100
  81   S  L  L  E  K  F  Y  T  E  L  Y  Q  Q  L  N  D  L  E  A  C   Infergen
  81   S  L  L  E  K  F  Y  T  E  L  Y  Q  Q  L  N  D  L  E  A  C   Infergen D73N
  81   S  L  L  E  K  F  Y  T  E  L  Y  Q  Q  L  N  D  L  E  A  C   Infergen D79N
  81   S  L  L  E  K  F  Y  T  E  L  Y  Q  Q  L  N  D  L  E  A  C   Infergen E108T
  81   S  L  L  E  K  F  Y  T  E  L  Y  Q  Q  L  N  D  L  E  A  C   Infergen E108N
  81   S  L  L  E  K  F  Y  T  E  L  Y  Q  Q  L  N  D  L  E  A  C   Infergen D73N_D79N
  81   S  L  L  E  K  F  Y  T  E  L  Y  Q  Q  L  N  D  L  E  A  C   Infergen D73N_E108T
  81   S  L  L  E  K  F  Y  T  E  L  Y  Q  Q  L  N  D  L  E  A  C   Infergen D79N_E108T
  81   S  L  L  E  K  F  Y  T  E  L  Y  Q  Q  L  N  D  L  E  A  C   Infergen D73N_E108N
  81   S  L  L  E  K  F  Y  T  E  L  Y  Q  Q  L  N  D  L  E  A  C   Infergen D79N_E108N
  81   S  L  L  E  K  F  Y  T  E  L  Y  Q  Q  L  N  D  L  E  A  C   Infergen D73N_D79N_E108T
  81   S  L  L  E  K  F  Y  T  E  L  Y  Q  Q  L  N  D  L  E  A  C   Infergen D73N_D79N_E108N V  I  Q  E  V  G  V  T  E  T  P  L  M  N  V  D  S  I  L  A   Majority
                                      110                     120
 101   V  I  Q  E  V  G  V [E] E  T  P  L  M  N  V  D  S  I  L  A   Infergen
 101   V  I  Q  E  V  G  V [E] E  T  P  L  M  N  V  D  S  I  L  A   Infergen D73N
 101   V  I  Q  E  V  G  V [E] E  T  P  L  M  N  V  D  S  I  L  A   Infergen D79N
 101   V  I  Q  E  V  G  V  T  E  T  P  L  M  N  V  D  S  I  L  A   Infergen E108T
 101   V  I  Q  E  V  G  V [N] E  T  P  L  M  N  V  D  S  I  L  A   Infergen E108N
 101   V  I  Q  E  V  G  V [E] E  T  P  L  M  N  V  D  S  I  L  A   Infergen D73N_D79N
 101   V  I  Q  E  V  G  V  T  E  T  P  L  M  N  V  D  S  I  L  A   Infergen D73N_E108T
 101   V  I  Q  E  V  G  V  T  E  T  P  L  M  N  V  D  S  I  L  A   Infergen D79N_E108T
 101   V  I  Q  E  V  G  V [N] E  T  P  L  M  N  V  D  S  I  L  A   Infergen D73N_E108N
 101   V  I  Q  E  V  G  V [N] E  T  P  L  M  N  V  D  S  I  L  A   Infergen D79N_E108N
 101   V  I  Q  E  V  G  V  T  E  T  P  L  M  N  V  D  S  I  L  A   Infergen D73N_D79N_E108T
 101   V  I  Q  E  V  G  V [N] E  T  P  L  M  N  V  D  S  I  L  A   Infergen D73N_D79N_

Figure 26

Hind III
                                                            A1
AGCTTGCCACCATGTGCGACCTGCCCCAGACCCACAGCCTGGGCAACCGCCGCGCCCTGATCCTGCTGGCCCAGATGCGCCGCAT
     ACGGTGGTACACGCTGGACGGGGTCTGGGTGTCGGACCCGTTGGCGGCGCGGGACTAGGACGACCGGGTCTACGCGGCG
                                                    A2
          M  C  D  L  P  Q  T  H  S  L  G  N  R  R  A  L  I  L  L  A  Q  M  R  R  I
          |_____Infergen_____
                                    B1
CAGCCCC ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓
        ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓
                                    B2
   S  P  F  S  C  L  K  D  R  H  D  F  G  F  P  Q  E  E  F  D  G  N  Q  F  Q  K
   _____Infergen_____
                                    C1
▓▓▓▓▓▓▓▓▓▓▓▓▓▓▓▓▓ TGCTGCACGAGATGATCCAGCAGACCTTCAACCTGTTCAGCACCAAGGACAGCAGCGCCGCCTGG
▓▓▓▓▓▓▓▓▓▓▓▓▓▓▓▓▓ GGTAGTCGCACGAGGTGCTCTACTAGGTCGTCTGGAAGTTGGACAAGTCGTGGTTCCTGTCGTCGCGGCGGACC
                                    C2
   A  Q  A  I  S  Y  L  H  E  M  I  Q  Q  T  F  N  L  F  S  T  K  D  S  S  A  A  W
   _____Infergen_____
                                    D1
GACGAGAGCCTGCTGGAGAA ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓
CTGCTCTCGGA ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓
                                    D2
   D  E  S  L  L  E  K  F  Y  T  E  L  Y  Q  Q  L  N  D  L  E  A  C  V  I  Q  E  V
   _____Infergen_____
                                                                            E1
▓▓▓▓▓▓▓▓▓▓▓▓▓▓▓▓▓▓▓▓▓▓▓▓▓▓▓▓▓▓▓▓▓▓▓▓ ACAGCATCCTGGCCGTGAAGAAGTACTTCCAGCGCATCACCCTGTACC
▓▓▓▓▓▓▓▓▓▓▓▓▓▓▓▓▓▓▓▓▓▓▓▓▓▓▓▓▓▓▓▓▓▓▓▓ ACTTGCACCTGTCGTAGGACCGGCACTTCTTCATGAAGGTCGCGTAGTGGGACATGG
                                                                            E2
   G  V  E  E  T  P  L  H  N  V  D  S  I  L  A  V  K  K  Y  F  Q  R  I  T  L  Y
   _____Infergen_____
                                                                            F1
TGACCGAGAAGAAGTACAGCCCCTGCGCCTGGGAGGTGG ▓▓▓▓▓▓▓▓▓▓▓▓▓▓▓▓▓▓▓▓▓▓▓▓▓▓▓▓▓▓▓▓▓▓▓
ACTGGCTCTTCTTCATGTCGGGGACGCGGA ▓▓▓▓▓▓▓▓▓▓▓▓▓▓▓▓▓▓▓▓▓▓▓▓▓▓▓▓▓▓▓▓▓▓▓▓▓▓▓▓▓▓
                                                                            F2
   L  T  E  K  K  Y  S  P  C  A  W  E  V  V  R  A  E  I  M  R  S  F  S  L  S  T  N
   _____Infergen_____

▓▓▓▓▓▓▓▓▓▓▓▓▓▓▓▓▓▓▓▓▓▓▓▓▓▓▓▓▓▓▓▓▓▓▓▓▓▓▓▓▓▓
▓▓▓▓▓▓▓▓▓▓▓▓▓▓▓▓▓▓▓▓▓▓▓▓▓▓▓▓▓▓▓▓▓▓▓▓▓▓▓▓▓▓

L  Q  E  R  L  R  R  K  E       EcoR I
   _____Infergen_____|

Figure 27

```
      A G G A C A G C A G C G C C G C C T G G  Majority
                         230                 240
221   A G G A C A G C A G C G C C G C C T G G  MAMMALIAN INFERGEN
221   A G A A C A G C A G C G C C G C C T G G  MAMMALIAN INFERGEN D73N
221   A G G A C A G C A G C G C C G C C T G G  MAMMALIAN INFERGEN D79N
221   A G G A C A G C A G C G C C G C C T G G  MAMMALIAN INFERGEN E108N
221   A G G A C A G C A G C G C C G C C T G G  MAMMALIAN INFERGEN E108T
221   A G A A C A G C A G C G C C G C C T G G  MAMMALIAN INFERGEN D73N_D79N
221   A G A A C A G C A G C G C C G C C T G G  MAMMALIAN INFERGEN D73N_E108N
221   A G A A C A G C A G C G C C G C C T G G  MAMMALIAN INFERGEN D73N_E108T
221   A G G A C A G C A G C G C C G C C T G G  MAMMALIAN INFERGEN D79N_E108N
221   A G G A C A G C A G C G C C G C C T G G  MAMMALIAN INFERGEN D79N_E108T
221   A G A A C A G C A G C G C C G C C T G G  MAMMALIAN INFERGEN D73N_D79N_E108N
221   A G A A C A G C A G C G C C G C C T G G  MAMMALIAN INFERGEN D73N_D79N_E108T G A C G A G A G C C T G C T G G A G A A  Majority
                         250                 260
241   G A C G A G A G C C T G C T G G A G A A  MAMMALIAN INFERGEN
241   G A C G A G A G C C T G C T G G A G A A  MAMMALIAN INFERGEN D73N
241   A A C G A G A G C C T G C T G G A G A A  MAMMALIAN INFERGEN D79N
241   G A C G A G A G C C T G C T G G A G A A  MAMMALIAN INFERGEN E108N
241   G A C G A G A G C C T G C T G G A G A A  MAMMALIAN INFERGEN E108T
241   A A C G A G A G C C T G C T G G A G A A  MAMMALIAN INFERGEN D73N_D79N
241   G A C G A G A G C C T G C T G G A G A A  MAMMALIAN INFERGEN D73N_E108N
241   G A C G A G A G C C T G C T G G A G A A  MAMMALIAN INFERGEN D73N_E108T
241   A A C G A G A G C C T G C T G G A G A A  MAMMALIAN INFERGEN D79N_E108N
241   A A C G A G A G C C T G C T G G A G A A  MAMMALIAN INFERGEN D79N_E108T
241   A A C G A G A G C C T G C T G G A G A A  MAMMALIAN INFERGEN D73N_D79N_E108N
241   A A C G A G A G C C T G C T G G A G A A  MAMMALIAN INFERGEN D73N_D79N_E108T G T T C T A C A C C G A G C T G T A C C  Majority
                         270                 280
261   G T T C T A C A C C G A G C T G T A C C  MAMMALIAN INFERGEN
261   G T T C T A C A C C G A G C T G T A C C  MAMMALIAN INFERGEN D73N
261   G T T C T A C A C C G A G C T G T A C C  MAMMALIAN INFERGEN D79N
261   G T T C T A C A C C G A G C T G T A C C  MAMMALIAN INFERGEN E108N
261   G T T C T A C A C C G A G C T G T A C C  MAMMALIAN INFERGEN E108T
261   G T T C T A C A C C G A G C T G T A C C  MAMMALIAN INFERGEN D73N_D79N
261   G T T C T A C A C C G A G C T G T A C C  MAMMALIAN INFERGEN D73N_E108N
261   G T T C T A C A C C G A G C T G T A C C  MAMMALIAN INFERGEN D73N_E108T
261   G T T C T A C A C C G A G C T G T A C C  MAMMALIAN INFERGEN D79N_E108N
261   G T T C T A C A C C G A G C T G T A C C  MAMMALIAN INFERGEN D79N_E108T
261   G T T C T A C A C C G A G C T G T A C C  MAMMALIAN INFERGEN D73N_D79N_E108N
261   G T T C T A C A C C G A G C T G T A C C  MAMMALIAN INFERGEN D73N_D79N_E108T A G C A G C T G A A C G A C C T G G A G  Majority
                         290                 300
281   A G C A G C T G A A C G A C C T G G A G  MAMMALIAN INFERGEN
281   A G C A G C T G A A C G A C C T G G A G  MAMMALIAN INFERGEN D73N
281   A G C A G C T G A A C G A C C T G G A G  MAMMALIAN INFERGEN D79N
281   A G C A G C T G A A C G A C C T G G A G  MAMMALIAN INFERGEN E108N
281   A G C A G C T G A A C G A C C T G G A G  MAMMALIAN INFERGEN E108T
281   A G C A G C T G A A C G A C C T G G A G  MAMMALIAN INFERGEN D73N_D79N
281   A G C A G C T G A A C G A C C T G G A G  MAMMALIAN INFERGEN D73N_E108N
281   A G C A G C T G A A C G A C C T G G A G  MAMMALIAN INFERGEN D73N_E108T
281   A G C A G C T G A A C G A C C T G G A G  MAMMALIAN INFERGEN D79N_E108N
281   A G C A G C T G A A C G A C C T G G A G  MAMMALIAN INFERGEN D79N_E108T
281   A G C A G C T G A A C G A C C T G G A G  MAMMALIAN INFERGEN D73N_D79N_E108N
281   A G C A G C T G A A C G A C C T G G A G  MAMMALIAN INFERGEN D73N_D79N_E108T G C C T G C G T G A T C C A G G A G G T  Majority
                         310                 320
301   G C C T G C G T G A T C C A G G A G G T  MAMMALIAN INFERGEN
301   G C C T G C G T G A T C C A G G A G G T  MAMMALIAN INFERGEN D73N
301   G C C T G C G T G A T C C A G G A G G T  MAMMALIAN INFERGEN D79N
301   G C C T G C G T G A T C C A G G A G G T  MAMMALIAN INFERGEN E108N
301   G C C T G C G T G A T C C A G G A G G T  MAMMALIAN INFERGEN E108T
301   G C C T G C G T G A T C C A G G A G G T  MAMMALIAN INFERGEN D73N_D79N
301   G C C T G C G T G A T C C A G G A G G T  MAMMALIAN INFERGEN D73N_E108N
301   G C C T G C G T G A T C C A G G A G G T  MAMMALIAN INFERGEN D73N_E108T
301   G C C T G C G T G A T C C A G G A G G T  MAMMALIAN INFERGEN D79N_E108N
301   G C C T G C G T G A T C C A G G A G G T  MAMMALIAN INFERGEN D79N_E108T
301   G C C T G C G T G A T C C A G G A G G T  MAMMALIAN INFERGEN D73N_D79N_E108N
301   G C C T G C G T G A T C C A G G A G G T  MAMMALIAN INFERGEN D73N_D79N_E108T G G G C G T G A A C G A G A C C C C C C  Majority
                         330                 340
321   G G G C G T G G A G G A G A C C C C C C  MAMMALIAN INFERGEN
321   G G G C G T G G A G G A G A C C C C C C  MAMMALIAN INFERGEN D73N
321   G G G C G T G G A G G A G A C C C C C C  MAMMALIAN INFERGEN D79N
321   G G G C G T G A A C G A G A C C C C C C  MAMMALIAN INFERGEN E108N
321   G G G C G T G A C C G A G A C C C C C C  MAMMALIAN INFERGEN E108T
321   G G G C G T G G A G G A G A C C C C C C  MAMMALIAN INFERGEN D73N_D79N
321   G G G C G T G A A C G A G A C C C C C C  MAMMALIAN INFERGEN D73N_E108N
321   G G G C G T G A C C G A G A C C C C C C  MAMMALIAN INFERGEN D73N_E108T
321   G G G C G T G A A C G A G A C C C C C C  MAMMALIAN INFERGEN D79N_E108N
321   G G G C G T G A C C G A G A C C C C C C  MAMMALIAN INFERGEN D79N_E108T
321   G G G C G T G A A C G A G A C C C C C C  MAMMALIAN INFERGEN D73N_D79N_E108N
321   G G G C G T G A C C G A G A C C C C C C  MAMMALIAN INFERGEN D73N_D79N_E108T

Figure 28

```
                                        Site 1
                                          ↓
         Y E M L Q N I F A I F R Q D S S S T G W   Majority
                           90                100
    81   Y E M L Q N I F A I F R Q D S  S S T G W   h IFN beta 1
    81   Y E M L Q N I F A I F R Q D [N] S S T G W   h IFN beta 1_S95N
    81   Y E M L Q N I F A I F R Q D S  S S T G W   h IFN beta 1_E130T
    81   Y E M L Q N I F A I F R Q D S  S S T G W   h IFN beta 1_E130N_F132T
    81   Y E M L Q N I F A I F R Q D [N] S S T G W   h IFN beta 1_S95N_E130T
    81   Y E M L Q N I F A I F R Q D [N] S S T G W   h IFN beta 1_S95N_E130N_F132T N E T I V E N L L A N V Y H Q I N H L K   Majority
                           110               120
   101  [N] E T I V E N L L A N V Y H Q I N H L K   h IFN beta 1
   101   N  E T I V E N L L A N V Y H Q I N H L K   h IFN beta 1_S95N
   101   N  E T I V E N L L A N V Y H Q I N H L K   h IFN beta 1_E130T
   101   N  E T I V E N L L A N V Y H Q I N H L K   h IFN beta 1_E130N_F132T
   101   N  E T I V E N L L A N V Y H Q I N H L K   h IFN beta 1_S95N_E130T
   101  [N] E T I V E N L L A N V Y H Q I N H L K   h IFN beta 1_S95N_E130N_F132T T V L E E K L E K T D F T R G K L M S S   Majority
                           130               140
   121   T V L E E K L E K [E] D F T R G K L M S S   h IFN beta 1
   121   T V L E E K L E K [E] D F T R G K L M S S   h IFN beta 1_S95N
   121   T V L E E K L E K  T  D F T R G K L M S S   h IFN beta 1_E130T
   121   T V L E E K L E K [N] D [T] T R G K L M S S   h IFN beta 1_E130N_F132T
   121   T V L E E K L E K  T  D F T R G K L M S S   h IFN beta 1_S95N_E130T
   121   T V L E E K L E K [N] D [T] T R G K L M S S   h IFN beta 1_S95N_E130N_F132T
                            ↑
                          Site 2
```

Figure 29

Site 1

| | | | | | | | | | | | | | | | | | | | | | |
|---|---|---|---|---|---|---|---|---|---|---|---|---|---|---|---|---|---|---|---|---|---|
| | H | E | M | L | Q | Q | I | F | S | L | F | H | T | E | N | S | S | A | A | W | Majority |
| | | | | | | | | | | 90 | | | | | | | | | | 100 | |
| 81 | H | E | M | L | Q | Q | I | F | S | L | F | H | T | E | R | S | S | A | A | W | h IFN Omega 1 |
| 81 | H | E | M | L | Q | Q | I | F | S | L | F | H | T | E | N | S | S | A | A | W | h IFN Omega 1_R95N |
| 81 | H | E | M | L | Q | Q | I | F | S | L | F | H | T | E | R | S | S | A | A | W | h IFN Omega 1_G130T |
| 81 | H | E | M | L | Q | Q | I | F | S | L | F | H | T | E | R | S | S | A | A | W | h IFN Omega 1_G130N |
| 81 | H | E | M | L | Q | Q | I | F | S | L | F | H | T | E | N | S | S | A | A | W | h IFN Omega 1_R95N_G130N |
| 81 | H | E | M | L | Q | Q | I | F | S | L | F | H | T | E | N | S | S | A | A | W | h IFN Omega 1_R95N_G130T |

| | | | | | | | | | | | | | | | | | | | | | |
|---|---|---|---|---|---|---|---|---|---|---|---|---|---|---|---|---|---|---|---|---|---|
| | N | M | T | L | L | D | Q | L | H | T | G | L | H | Q | Q | L | Q | H | L | E | Majority |
| | | | | | | | | | | 110 | | | | | | | | | | 120 | |
| 101 | N | M | T | L | L | D | Q | L | H | T | G | L | H | Q | Q | L | Q | H | L | E | h IFN Omega 1 |
| 101 | N | M | T | L | L | D | Q | L | H | T | G | L | H | Q | Q | L | Q | H | L | E | h IFN Omega 1_R95N |
| 101 | N | M | T | L | L | D | Q | L | H | T | G | L | H | Q | Q | L | Q | H | L | E | h IFN Omega 1_G130T |
| 101 | N | M | T | L | L | D | Q | L | H | T | G | L | H | Q | Q | L | Q | H | L | E | h IFN Omega 1_G130N |
| 101 | N | M | T | L | L | D | Q | L | H | T | G | L | H | Q | Q | L | Q | H | L | E | h IFN Omega 1_R95N_G130N |
| 101 | N | M | T | L | L | D | Q | L | H | T | G | L | H | Q | Q | L | Q | H | L | E | h IFN Omega 1_R95N_G130T |

| | | | | | | | | | | | | | | | | | | | | | |
|---|---|---|---|---|---|---|---|---|---|---|---|---|---|---|---|---|---|---|---|---|---|
| | T | C | L | L | Q | V | V | G | E | G | E | S | A | G | A | I | S | S | P | A | Majority |
| | | | | | | | | | | 130 | | | | | | | | | | 140 | |
| 121 | T | C | L | L | Q | V | V | G | E | G | E | S | A | G | A | I | S | S | P | A | h IFN Omega 1 |
| 121 | T | C | L | L | Q | V | V | G | E | G | E | S | A | G | A | I | S | S | P | A | h IFN Omega 1_R95N |
| 121 | T | C | L | L | Q | V | V | G | E | T | E | S | A | G | A | I | S | S | P | A | h IFN Omega 1_G130T |
| 121 | T | C | L | L | Q | V | V | G | E | N | E | S | A | G | A | I | S | S | P | A | h IFN Omega 1_G130N |
| 121 | T | C | L | L | Q | V | V | G | E | N | E | S | A | G | A | I | S | S | P | A | h IFN Omega 1_R95N_G130N |
| 121 | T | C | L | L | Q | V | V | G | E | T | E | S | A | G | A | I | S | S | P | A | h IFN Omega 1_R95N_G130T |

Site 2

Figure 31 human IFN-γ amino acid sequence

Gln Asp Pro Tyr Val Lys Glu Ala Glu Asn Leu Lys Lys Tyr Phe Asn
 1             5                 10               15

Ala Gly His Ser Asp Val Ala Asp Asn Gly Thr Leu Phe Leu Gly Ile
        20               25               30

Leu Lys Asn Trp Lys Glu Glu Ser Asp Arg Lys Ile Met Gln Ser Gln
       35               40              45

Ile Val Ser Phe Tyr Phe Lys Leu Phe Lys Asn Phe Lys Asp Asp Gln
     50               55              60

Ser Ile Gln Lys Ser Val Glu Thr Ile Lys Glu Asp Met Asn Val Lys
  65             70               75              80

Phe Phe Asn Ser Asn Lys Lys Lys Arg Asp Asp Phe Glu Lys Leu Thr
        85               90              95

Asn Tyr Ser Val Thr Asp Leu Asn Val Gln Arg Lys Ala Ile His Glu
      100             105            110

Leu Ile Gln Val Met Ala Glu Leu Ser Pro Ala Ala Lys Thr Gly Lys
    115              120            125

Arg Lys Arg Ser Gln Met Leu Phe Arg Gly Arg Arg Ala Ser Gln
    130              135            140

Figure 33

SEQID description    sequence 1406 alpha 1 (N)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1407 alpha 1 (31)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1408 alpha 1 (102)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1409 alpha 1 (108)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu

Figure 33 Continued 1410 alpha 1 (138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1411 alpha 1 (31,102)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1412 alpha 1 (31,108)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1413 alpha 1 (31,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1414 alpha 1 (102,108)

Figure 33 Continued

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1415 alpha 1 (102,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1416 alpha 1 (108,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1417 alpha 1 (31,102,108)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1418 alpha 1 (31,102,138)

Figure 33 Continued

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1419 alpha 1 (31,108,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1420 alpha 1 (102,108,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1421 alpha 1 (31,102,108,138)

Met-Ala-Ser-Pro-Phe-Ala-Leu-Leu-Met-Val-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1422 alpha 2a (N)

Figure 33 Continued

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1423 alpha 2a (31)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1424 alpha 2a (102)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1425 alpha 2a (108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1426 alpha 2a (138)    0000

1427 alpha 2a (31,102)

Figure 33 Continued

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1428 alpha 2a (31,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1429 alpha 2a (31,138)   0000

1430 alpha 2a (102,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1431 alpha 2a (102,138)   0000

1432 alpha 2a (108,138)   0000

1433 alpha 2a (31,102,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Lys-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu

Figure 33 Continued 1434 alpha 2a (31,102,138)   0000

1435 alpha 2a (31,108,138)   0000

1436 alpha 2a (102,108,138)   0000

1437 alpha 2a (31,102,108,138)   0000

1438 alpha 2b

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1439 alpha 2b (31)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1440 alpha 2b (102)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1441 alpha 2b (108)

Figure 33 Continued

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1442 alpha 2b (138)    0000

1443 alpha 2b (31,102)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly---Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asp-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1444 alpha 2b (31,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asp-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala--Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1445 alpha 2b (31,138)    0000

1446 alpha 2b (102,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asp-Leu-Pro-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu

Figure 33 Continued 1447 alpha 2b (102,138)   0000

1448 alpha 2b (108,138)   0000

1449 alpha 2b (31,102,108)

Met-Ala-Leu-Thr-Phe-Ala-Leu-Leu-Val-Ala-Leu-Leu-Val-Leu-Ser-Cys-Lys-Ser-Ser-
Cys-Ser-Val-Gly-Cys-Asn-Leu-Ser-Gln-Thr-His-Ser-Leu-Gly--Ser-Arg-Arg-Thr-Leu-
Met-Leu-Leu-Ala-Gln-Met-Arg-Arg-Ile-Ser-Leu-Phe-Ser-Cys-Leu-Lys-Asp-Arg-His-
Asp-Phe-Gly-Phe-Pro-Gln-Glu-Glu-Phe--Gly-Asn-Gln-Phe-Gln-Lys-Ala-Glu-Thr-Ile-
Pro-Val-Leu-His-Glu-Met-Ile-Gln-Gln-Ile-Phe-Asn-Leu-Phe-Ser-Thr-Lys-Asn-Ser-
Ser-Ala-Ala-Trp-Asn-Glu-Thr-Leu-Leu-Asp-Lys-Phe-Tyr-Thr-Glu-Leu-Tyr-Gln-Gln-
Leu-Asn-Asp-Leu-Glu-Ala-Cys-Val-Ile-Gln-Gly-Val-Gly--Val-Thr-Glu-Thr-Pro-Leu-
Met-Lys-Glu-Asp-Ser-Ile-Leu-Ala-Val-Arg-Lys-Tyr-Phe-Gln-Arg-Ile-Thr-Leu-Tyr-
Leu-Lys-Glu-Lys-Lys-Tyr-Ser-Pro-Cys-Ala-Trp-Glu-Val-Val-Arg-Ala-Glu-Ile-Met-
Arg-Ser-Phe-Ser-Leu-Ser-Thr-Asn-Leu-Gln-Glu-Ser-Leu-Arg-Ser-Lys-Glu 1450 alpha 2b (31,102,138)   0000

1451 alpha 2b (31,108,138)   0000

1452 alpha 2b (102,108,138)   0000

1453 alpha 2b (31,102,108,138)   0000

1454 alpha 4a

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1455 alpha 4a (31)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1456 alpha 4a (102)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1457 alpha 4a (108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1458 alpha 4a (138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1459 alpha 4a (31,102)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1460 alpha 4a (31,108)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1461 alpha 4a (31,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1462 alpha 4a (102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1463 alpha 4a (102,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1464 alpha 4a (108,138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1465 alpha 4a (31,102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1466 alpha 4a (31,102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1467 alpha 4a (31,108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1468 alpha 4a (102,108,138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1469 alpha 4a (31,102,108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1470 alpha 4b

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1471 alpha 4b (31)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1472 alpha 4b (102)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1473 alpha 4b (108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1474 alpha 4b (138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1475 alpha 4b (31,102)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1476 alpha 4b (31,108)
```

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1477 alpha 4b (31,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1478 alpha 4b (102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1479 alpha 4b (102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1480 alpha 4b (108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1481 alpha 4b (31,102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1482 alpha 4b (31,102,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1483 alpha 4b (31,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1484 alpha 4b (102,108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1485 alpha 4b (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-His-
Asp-Phe-Gly-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1486 alpha 5

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1487 alpha 5 (31)

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1488 alpha 5 (102)

Figure 33 Continued

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1489 alpha 5 (108)

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1490 alpha 5 (138)

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1491 alpha 5 (31,102)

Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu 1492 alpha 5 (31,108)

Figure 33 Continued

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1493 alpha 5 (31,138)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1494 alpha 5 (102,108)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1495 alpha 5 (102,138)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1496 alpha 5 (108,138)

Figure 33 Continued

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1497 alpha 5 (31,102,108)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Glu-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1498 alpha 5 (31,102,138)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asp-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1499 alpha 5 (31,108,138)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1500 alpha 5 (102,108,138)

Figure 33 Continued

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asp-Leu-Pro-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1501 alpha 5 (31,102,108,138)

```
Met-Ala-Leu-Pro-Phe-Val-Leu-Leu-Met-Ala-Leu-Val-Val-Leu-Asn-Cys-Lys-Ser-Ile-
Cys-Ser-Leu-Gly-Cys-Asn-Leu-Ser-Gln-Thr-His-Ser-Leu-Ser--Asn-Arg-Arg-Thr-Leu-
Met-Ile-Met-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Glu-Thr-Leu-Leu-Asp-Lys-Phe-Tyr-Thr-Glu-Leu-Tyr-Gln-
Gln-Leu-Asn-Asp-Leu-Glu-Ala-Cys-Met-Met-Gln-Glu-Val-Gly--Val-Thr-Asp-Thr-Pro-
Leu-Met-Asn-Val-Asp-Ser-Ile-Leu-Thr-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Ala-Asn-Leu-Gln-Glu-Arg-Leu-Arg-Arg-Lys-Glu
```

1502 alpha 6

```
Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu
```

1503 alpha 6 (31)

```
Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu
```

1504 alpha 6 (102)

Figure 33 Continued

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1505 alpha 6 (108)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1506 alpha 6 (138)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1507 alpha 6 (31,102)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1508 alpha 6 (31,108)

Figure 33 Continued

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1509 alpha 6 (31,138)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1510 alpha 6 (102,108)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1511 alpha 6 (102,138)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1512 alpha 6 (108,138)

Figure 33 Continued

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1513 alpha 6 (31,102,108)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Gly-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1514 alpha 6 (31,102,138)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asp-Glu-Arg-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1515 alpha 6 (31,108,138)

Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asp-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu 1516 alpha 6 (102,108,138)

Figure 33 Continued

```
Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asp-Leu-Pro-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu
```

1517 alpha 6 (31,102,108,138)

```
Met-Ala-Leu-Pro-Phe-Ala-Leu-Leu-Met-Ala-Leu-Val-Val-Leu-Ser-Cys-Lys-Ser-Ser-
Cys-Ser-Leu-Asp-Cys-Asn-Leu-Ser-Gln-Thr-His-Ser-Leu-Gly--His-Arg-Arg-Thr-Met-
Met-Leu-Leu-Ala-Gln-Met-Arg-Arg-Ile-Ser-Leu-Phe-Ser-Cys-Leu-Lys-Asp-Arg-His-
Asp-Phe-Arg-Phe-Pro-Gln-Glu-Glu-Phe-Asp-Gly-Asn-Gln-Phe-Gln-Lys-Ala-Glu-Ala-
Ile-Ser-Val-Leu-His-Glu-Val-Ile-Gln-Gln-Thr-Phe-Asn-Leu-Phe-Ser-Thr-Lys-Asn-
Ser-Ser-Val-Ala-Trp-Asn-Glu-Thr-Leu-Leu-Asp-Lys-Leu-Tyr-Thr-Glu-Leu-Tyr-Gln-
Gln-Leu-Asn-Asp-Leu-Glu-Ala-Cys-Val-Met-Gln-Glu-Val-Trp--Val-Thr-Gly-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Ser-Ser-Arg-Asn-Leu-Gln-Glu-Arg-Leu-Arg-Arg-Lys-Glu
```

1518 alpha 7

```
Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1519 alpha 7 (31)

```
Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1520 alpha 7 (102)

Figure 33 Continued

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1521 alpha 7 (108)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1522 alpha 7 (138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1523 alpha 7 (31,102)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1524 alpha 7 (31,108)

Figure 33 Continued

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1525  alpha 7 (31,138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1526  alpha 7 (102,108)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1527  alpha 7 (102,138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1528  alpha 7 (108,138)

Figure 33 Continued

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1529 alpha 7 (31,102,108)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1530 alpha 7 (31,102,138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1531 alpha 7 (31,108,138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1532 alpha 7 (102,108,138)

Figure 33 Continued

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1533 alpha 7 (31,102,108,138)

Met-Ala-Arg-Ser-Phe-Ser-Leu-Leu-Met-Val-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1534 alpha 8

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1535 alpha 8 (31)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1536 alpha 8 (102)

Figure 33 Continued

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1537 alpha 8 (108)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1538 alpha 8 (138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1539 alpha 8 (31,102)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1540 alpha 8 (31,108)

Figure 33 Continued

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1541 alpha 8 (31,138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1542 alpha 8 (102,108)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1543 alpha 8 (102,138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1544 alpha 8 (108,138)

Figure 33 Continued

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1545 alpha 8 (31,102,108)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Ile-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1546 alpha 8 (31,102,138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asp-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1547 alpha 8 (31,108,138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1548 alpha 8 (102,108,138)

Figure 33 Continued

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1549 alpha 8 (31,102,108,138)

Met-Ala-Leu-Thr-Phe-Tyr-Leu-Leu-Val-Ala-Leu-Val-Val-Leu-Ser-Tyr-Lys-Ser-Phe-
Ser-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Asp-Lys-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Leu-Asn-Glu-Thr-Leu-Leu-Asp-Glu-Phe-Tyr-Ile-Glu-Leu-Asp-Gln-
Gln-Leu-Asn-Asp-Leu-Glu-Ser-Cys-Val-Met-Gln-Glu-Val-Gly--Val-Thr-Glu-Ser-Pro-
Leu-Met-Tyr-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Ser-Cys-Ala-Trp-Glu-Val-Val-Arg-Ala-Glu-Ile-
Met-Arg-Ser-Phe-Ser-Leu-Ser-Ile-Asn-Leu-Gln-Lys-Arg-Leu-Lys-Ser-Lys-Glu 1550 alpha 10

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1551 alpha 10 (31)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1552 alpha 10 (102)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1553 alpha 10 (108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1554 alpha 10 (138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1555 alpha 10 (31,102)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1556 alpha 10 (31,108)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1557 alpha 10 (31,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1558 alpha 10 (102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1559 alpha 10 (102,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1560 alpha 10 (108,138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1561 alpha 10 (31,102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1562 alpha 10 (31,102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1563 alpha 10 (31,108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp
```

1564 alpha 10 (102,108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1565 alpha 10 (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Gly-Gln-Met-Gly-Arg-Ile-Ser-Pro-Phe-Ser-Cys-Leu-Lys-Asp-Arg-His-
Asp-Phe-Arg-Ile-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Ile-Glu-Arg-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1566 alpha 13

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1567 alpha 13 (31)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1568 alpha 13 (102)

Figure 33 Continued

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1569 alpha 13 (108)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1570 alpha 13 (138)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1571 alpha 13 (31,102)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1572 alpha 13 (31,108)

Figure 33 Continued

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1573 alpha 13 (31,138)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1574 alpha 13 (102,108)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1575 alpha 13 (102,138)

Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu 1576 alpha 13 (108,138)

Figure 33 Continued

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1577 alpha 13 (31,102,108)

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Gly-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1578 alpha 13 (31,102,138)

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asp-Glu-Asp-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1579 alpha 13 (31,108,138)

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asp-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1580 alpha 13 (102,108,138)

Figure 33 Continued

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asp-Leu-Pro-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1581 alpha 13 (31,102,108,138)

```
Met-Ala-Ser-Pro-Phe-Ala-Leu-Leu-Met-Ala-Leu-Val-Val-Leu-Ser-Cys-Lys-Ser-Ser-
Cys-Ser-Leu-Gly-Cys-Asn-Leu-Ser-Glu-Thr-His-Ser-Leu-Asp--Asn-Arg-Arg-Thr-Leu-
Met-Leu-Leu-Ala-Gln-Met-Ser-Arg-Ile-Ser-Pro-Ser-Ser-Cys-Leu-Met-Asp-Arg-His-
Asp-Phe-Gly-Phe-Pro-Gln-Glu-Glu-Phe-Asp-Gly-Asn-Gln-Phe-Gln-Lys-Ala-Pro-Ala-
Ile-Ser-Val-Leu-His-Glu-Leu-Ile-Gln-Gln-Ile-Phe-Asn-Leu-Phe-Thr-Thr-Lys-Asn-
Ser-Ser-Ala-Ala-Trp-Asn-Glu-Thr-Leu-Leu-Asp-Lys-Phe-Cys-Thr-Glu-Leu-Tyr-Gln-
Gln-Leu-Asn-Asp-Leu-Glu-Ala-Cys-Val-Met-Gln-Glu-Glu-Arg--Val-Thr-Glu-Thr-Pro-
Leu-Met-Asn-Ala-Asp-Ser-Ile-Leu-Ala-Val-Lys-Lys-Tyr-Phe-Arg-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Leu-Ser-Thr-Asn-Leu-Gln-Glu-Arg-Leu-Arg-Arg-Lys-Glu
```

1582 alpha 14

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn---Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asp-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Arg-Leu-Arg-Arg-Lys-Asp
```

1583 alpha 14 (31)    0000

1584 alpha 14 (102)    0000

1585 alpha 14 (108)

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn---Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asn-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Arg-Leu-Arg-Arg-Lys-Asp
```

1586 alpha 14 (138)

Figure 33 Continued

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asp-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Arg-Leu-Arg-Arg-Lys-Asp 1587 alpha 14 (31,102)    0000

1588 alpha 14 (31,108)    0000

1589 alpha 14 (31,138)    0000

1590 alpha 14 (102,108)   0000

1591 alpha 14 (102,138)   0000

1592 alpha 14 (108,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asn-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Arg-Leu-Arg-Arg-Lys-Asp 1593 alpha 14 (31,102,108)    0000

1594 alpha 14 (31,102,138)    0000

1595 alpha 14 (31,108,138)    0000

1596 alpha 14 (102,108,138)   0000

1597 alpha 14 (31,102,108,138) 0000

1598 alpha 16

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp

Figure 33 Continued 1599 alpha 16 (31)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1600 alpha 16 (102)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1601 alpha 16 (108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1602 alpha 16 (138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1603 alpha 16 (31,102)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1604 alpha 16 (31,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1605 alpha 16 (31,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1606 alpha 16 (102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1607 alpha 16 (102,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1608 alpha 16 (108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1609 alpha 16 (31,102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Glu-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1610 alpha 16 (31,102,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asp-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1611 alpha 16 (31,108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asp-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1612 alpha 16 (102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1613 alpha 16 (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-His-Phe-Ser-Cys-Leu-Lys-Asp-Arg-Tyr-
Asp-Phe-Gly-Phe-Pro-Gln-Glu-Val-Phe-Asp-Gly-Asn-Gln-Phe-Gln-Lys-Ala-Gln-Ala-
Ile-Ser-Ala-Phe-His-Glu-Met-Ile-Gln-Gln-Thr-Phe-Asn-Leu-Phe-Ser-Thr-Lys-Asn-
Ser-Ser-Ala-Ala-Trp-Asn-Glu-Thr-Leu-Leu-Asp-Lys-Phe-Tyr-Ile-Glu-Leu-Phe-Gln-
Gln-Leu-Asn-Asp-Leu-Glu-Ala-Cys-Val-Thr-Gln-Glu-Val-Gly--Val-Thr-Glu-Ile-Ala-
Leu-Met-Asn-Glu-Asp-Ser-Ile-Leu-Ala-Val-Arg-Lys-Tyr-Phe-Gln-Arg-Ile-Thr-Leu-
Tyr-Leu-Met-Gly-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Gln-Lys-Gly-Leu-Arg-Arg-Lys-Asp 1614 alpha 17

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1615 alpha 17 (31)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1616 alpha 17 (102)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1617 alpha 17 (108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1618 alpha 17 (138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1619 alpha 17 (31,102)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1620 alpha 17 (31,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1621 alpha 17 (31,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1622 alpha 17 (102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1623 alpha 17 (102,138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1624 alpha 17 (108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1625 alpha 17 (31,102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1626 alpha 17 (31,102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1627 alpha 17 (31,108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1628 alpha 17 (102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1629 alpha 17 (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1630 alpha 21

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1631 alpha 21 (31)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1632 alpha 21 (102)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1633 alpha 21 (108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1634 alpha 21 (138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1635 alpha 21 (31,102)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1636 alpha 21 (31,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1637 alpha 21 (31,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1638 alpha 21 (102,108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1639 alpha 21 (102,138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu
```

1640 alpha 21 (108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu
```

1641 alpha 21 (31,102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu
```

1642 alpha 21 (31,102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Glu-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu
```

1643 alpha 21 (31,108,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1644 alpha 21 (102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1645 alpha 21 (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Thr-Trp-Asn-Gln-Ser-Leu-Leu-Glu-Lys-Phe-Ser-Thr-Glu-Leu-Asn-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Val-Asp-Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Lys-Ile-Phe-Gln-Glu-Arg-Leu-Arg-Arg-Lys-Glu 1646 alpha H Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asp-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1647 alpha H (31)     0000

1648 alpha H (102)    0000

1649 alpha H (108)

Figure 33 Continued

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asn-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Glu-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1650 alpha H (138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asp-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1651 alpha H (31,102)    0000

1652 alpha H (31,108)    0000

1653 alpha H (31,138)    0000

1654 alpha H (102,108)   0000

1655 alpha H (102,138)   0000

1656 alpha H (108,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Asn--Asn-Arg-Arg-Thr-Leu-
Met-Leu-Met-Ala-Gln-Met-Arg-Arg-Ile-Ser-Pro-Phe-Ser-Cys-Leu-Lys-Asp-Arg-His-
Asp-Phe-Glu-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Met-Gln-Gln-Thr-Phe-Asn-Leu-Phe-Ser-Thr-Lys-Asn-
Ser-Ser-Ala-Ala-Trp-Asn-Glu-Thr-Leu-Leu-Glu-Lys-Phe-Tyr-Ile-Glu-Leu-Phe-Gln-
Gln-Met-Asn-Asp-Leu-Glu-Ala-Cys-Val-Ile-Gln-Glu-Val-Gly--Val-Thr-Glu-Thr-Pro-
Leu-Met-Asn-Glu-Asp-Ser-Ile-Leu-Ala-Val-Lys-Lys-Tyr-Phe-Gln-Arg-Ile-Thr-Leu-
Tyr-Leu-Met-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Arg-Leu-Arg-Arg-Lys-Asp 1657 alpha H (31,102,108)     0000

1658 alpha H (31,102,138)     0000

1659 alpha H (31,108,138)     0000

1660 alpha H (102,108,138)    0000

1661 alpha H (31,102,108,138) 0000

Figure 33 Continued 1662 alpha I

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1663 alpha I (31)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1664 alpha I (102)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1665 alpha I (108)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1666 alpha I (138)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1667 alpha I (31,102)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1668 alpha I (31,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1669 alpha I (31,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1670 alpha I (102,108)

Figure 33 Continued

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1671 alpha I (102,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1672 alpha I (108,138)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1673 alpha I (31,102,108)

```
Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Glu-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp
```

1674 alpha I (31,102,138)

Figure 33 Continued

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1675 alpha I (31,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1676 alpha I (102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1677 alpha I (31,102,108,138)

Met-Ala-Leu-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-Pro-
Asp-Phe-Gly-Leu-Pro-Gln-Glu-Glu-Phe-Asp-Gly-Asn-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asn-Leu-Glu-Ala-Cys-Val-Ile-Gln-Glu-Val-Gly--Met-Thr-Glu-Thr-Pro-
Leu-Met-Asn-Glu-Asp-Ser-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Leu-Ser-Phe-Ser-Thr-Asn-Leu-Gln-Lys-Ile-Leu-Arg-Arg-Lys-Asp 1678 alpha J1

Figure 33 Continued

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1679 alpha J1 (31)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1680 alpha J1 (102)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1681 alpha J1 (108)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1682 alpha J1 (138)

Figure 33 Continued

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1683 alpha J1 (31,102)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1684 alpha J1 (31,108)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1685 alpha J1 (31,138)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1686 alpha J1 (102,108)

Figure 33 Continued

```
Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1687 alpha J1 (102,138)

```
Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1688 alpha J1 (108,138)

```
Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1689 alpha J1 (31,102,108)

```
Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Glu-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp
```

1690 alpha J1 (31,102,138)

Figure 33 Continued

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Glu-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1691 alpha J1 (31,108,138)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asp-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1692 alpha J1 (102,108,138)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asp-Leu-Pro-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1693 alpha J1 (31,102,108,138)

Met-Ala-Arg-Ser-Phe-Ser-Leu-Leu-Met-Ala-Val-Leu-Val-Leu-Ser-Tyr-Lys-Ser-Ile-
Cys-Ser-Leu-Gly-Cys-Asn-Leu-Ser-Gln-Thr-His-Ser-Leu-Arg--Asn-Arg-Arg-Ala-Leu-
Ile-Leu-Leu-Ala-Gln-Met-Gly-Arg-Ile-Ser-Pro-Phe-Ser-Cys-Leu-Lys-Asp-Arg-His-
Glu-Phe-Arg-Phe-Pro-Glu-Glu-Glu-Phe-Asp-Gly-His-Gln-Phe-Gln-Lys-Thr-Gln-Ala-
Ile-Ser-Val-Leu-His-Glu-Met-Ile-Gln-Gln-Thr-Phe-Asn-Leu-Phe-Ser-Thr-Glu-Asn-
Ser-Ser-Ala-Ala-Trp-Asn-Gln-Ser-Leu-Leu-Glu-Lys-Phe-Ser-Thr-Glu-Leu-Tyr-Gln-
Gln-Leu-Asn-Asp-Leu-Glu-Ala-Cys-Val-Ile-Gln-Glu-Val-Gly--Val-Thr-Glu-Thr-Pro-
Leu-Met-Asn-Glu-Asp-Phe-Ile-Leu-Ala-Val-Arg-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Phe-Ser-Thr-Asn-Leu-Lys-Lys-Gly-Leu-Arg-Arg-Lys-Asp 1694 beta 1

Figure 33 Continued

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Leu-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Ser-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Glu-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1695 beta 1 (31)

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Ser-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Ser-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Glu-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1696 beta 1 (102)

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Leu-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Asn-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Glu-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1697 beta 1 (108)    0000

1698 beta 1 (138)

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Leu-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Ser-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Thr-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1699 beta 1 (31,102)

Figure 33 Continued

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Ser-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Asn-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Glu-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1700 beta 1 (31,108)    0000

1701 beta 1 (31,138)

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Ser-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Ser-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Thr-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1702 beta 1 (102,108)    0000

1703 beta 1 (102,138)

Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Leu-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Asn-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Thr-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn 1704 beta 1 (108,138)    0000

1705 beta 1 (31,102,108)    0000

1706 beta 1 (31,102,138)

Figure 33 Continued

```
Met-Thr-Asn-Lys-Cys-Leu-Leu-Gln-Ile-Ala-Leu-Leu-Leu-Cys-Phe-Ser-Thr-Thr-Ala-
Leu-Ser-Met-Ser-Tyr-Asn-Leu-Ser-Gly-Phe-Leu-Gln-Arg-Ser-Ser-Asn-Phe-Gln-Cys-
Gln-Lys-Leu-Leu-Trp-Gln-Leu-Asn-Gly-Arg--Leu-Glu-Tyr-Cys-Leu-Lys-Asp-Arg-Met-
Asn-Phe-Asp-Ile-Pro-Glu-Glu-Ile-Lys-Gln-Leu-Gln-Gln-Phe-Gln-Lys-Glu-Asp-Ala-
Ala-Leu-Thr-Ile-Tyr-Glu-Met-Leu-Gln-Asn-Ile-Phe-Ala-Ile-Phe-Arg-Gln-Asp-Asn-
Ser-Ser-Thr-Gly-Trp-Asn-Glu-Thr-Ile-Val-Glu-Asn-Leu-Leu-Ala-Asn-Val-Tyr-His-
Gln-Ile-Asn-His-Leu-Lys-Thr-Val-Leu-Glu-Glu-Lys-Leu-Glu--Lys-Thr-Asp-Phe-Thr-
Arg-Gly-Lys-Leu-Met-Ser-Ser-Leu-His-Leu-Lys-Arg-Tyr-Tyr-Gly-Arg-Ile-Leu-His-
Tyr-Leu-Lys-Ala-Lys-Glu-Tyr-Ser-His-Cys-Ala-Trp-Thr-Ile-Val-Arg-Val-Glu-Ile-
Leu-Arg-Asn-Phe-Tyr-Phe-Ile-Asn-Arg-Leu-Thr-Gly-Tyr-Leu-Arg-Asn
```

1707 beta 1 (31,108,138)   0000

1708 beta 1 (102,108,138)   0000

1709 beta 1 (31,102,108,138)   0000

1710 kappa

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1711 kappa (31)

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1712 kappa (102)

Figure 33 Continued

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1713 kappa (108)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1714 kappa (138)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1715 kappa (31,102)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1716 kappa (31,108)

Figure 33 Continued

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1717 kappa (31,138)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1718 kappa (102,108)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1719 kappa (102,138)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1720 kappa (108,138)

Figure 33 Continued

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1721 kappa (31,102,108)

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Pro-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1722 kappa (31,102,138)

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Lys-Glu-Arg-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1723 kappa (31,108,138)

```
Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Thr--Phe-Lys-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys
```

1724 kappa (102,108,138)

Figure 33 Continued

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Leu-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1725 kappa (31,102,108,138)

Met-Ser-Thr-Lys-Pro-Asp-Met-Ile-Gln-Lys-Cys-Leu-Trp-Leu-Glu-Ile-Leu-Met-Gly-
Ile-Phe-Ile-Ala-Gly-Thr-Leu-Ser-Leu-Asp-Cys-Asn-Leu-Ser-Asn-Val-His-Leu-Arg-
Arg-Val-Thr-Trp-Gln-Asn-Leu-Arg-His-Leu-Ser-Ser-Met-Ser-Asn-Ser-Phe-Pro-Val-
Glu-Cys-Leu-Arg-Glu-Asn-Ile-Ala-Phe-Glu-Leu-Pro-Gln-Glu-Phe-Leu-Gln-Tyr-Thr-
Gln-Pro-Met-Lys-Arg-Asp-Ile-Lys-Lys-Ala-Phe-Tyr-Glu-Met-Ser-Leu-Gln-Ala-Phe-
Asn-Ile-Phe-Ser-Gln-His-Asn--Phe-Ser-Tyr-Trp-Asn-Glu-Thr-His-Leu-Lys-Gln-Ile-
Gln-Ile-Gly-Leu-Asp-Gln-Gln-Ala-Glu-Tyr-Leu-Asn-Gln-Cys-Leu-Glu-Glu-Asp-Glu-
Asn-Glu-Asn-Glu-Asp-Met-Lys-Glu-Met-Lys-Glu-Asn-Glu-Met-Lys-Thr-Ser-Glu-Ala-
Arg-Val-Pro-Gln-Leu-Ser-Ser-Leu-Glu-Leu-Arg-Arg-Tyr-Phe-His-Arg-Ile-Asp-Asn-
Phe-Leu-Lys-Glu-Lys-Lys-Tyr-Ser-Asp-Cys-Ala-Trp-Glu-Ile-Val-Arg-Val-Glu-Ile-
Arg-Arg-Cys-Leu-Tyr-Tyr-Phe-Tyr-Lys-Phe-Thr-Ala-Leu-Phe-Arg-Arg-Lys 1726 omega 1

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asp-Leu-Pro-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Arg-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Gly-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1727 omega 1 (31)

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asn-Leu-Ser-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Arg-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Gly-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1728 omega 1 (102)

Figure 33 Continued

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asp-Leu-Pro-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Asn-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Gly-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1729 omega 1 (108)    0000

1730 omega 1 (138)

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asp-Leu-Pro-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Arg-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Thr-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1731 omega 1 (31,102)

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asn-Leu-Ser-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Asn-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Gly-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1732 omega 1 (31,108)    0000

1733 omega 1 (31,138)

Figure 33 Continued

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asn-Leu-Ser-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Arg-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Thr-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1734 omega 1 (102,108)  0000

1735 omega 1 (102,138)

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asp-Leu-Pro-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Asn-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Thr-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1736 omega 1 (108,138)  0000

1737 omega 1 (31,102,108)  0000

1738 omega 1 (31,102,138)

Met-Ala-Leu-Leu-Phe-Pro-Leu-Leu-Ala-Ala-Leu-Val-Met-Thr-Ser-Tyr-Ser-Pro-Val-
Gly-Ser-Leu-Gly-Cys-Asn-Leu-Ser-Gln-Asn-His-Gly-Leu-Leu--Ser-Arg-Asn-Thr-Leu-
Val-Leu-Leu-His-Gln-Met-Arg-Arg-Ile-Ser-Pro-Phe-Leu-Cys-Leu-Lys-Asp-Arg-Arg-
Asp-Phe-Arg-Phe-Pro-Gln-Glu-Met-Val-Lys-Gly-Ser-Gln-Leu-Gln-Lys-Ala-His-Val-
Met-Ser-Val-Leu-His-Glu-Met-Leu-Gln-Gln-Ile-Phe-Ser-Leu-Phe-His-Thr-Glu-Asn-
Ser-Ser-Ala-Ala-Trp-Asn-Met-Thr-Leu-Leu-Asp-Gln-Leu-His-Thr-Gly-Leu-His-Gln-
Gln-Leu-Gln-His-Leu-Glu-Thr-Cys-Leu-Leu-Gln-Val-Val-Gly--Glu-Thr-Glu-Ser-Ala-
Gly-Ala-Ile-Ser-Ser-Pro-Ala-Leu-Thr-Leu-Arg-Arg-Tyr-Phe-Gln-Gly-Ile-Arg-Val-
Tyr-Leu-Lys-Glu-Lys-Lys-Tyr-Ser-Asp-Cys-Ala-Trp-Glu-Val-Val-Arg-Met-Glu-Ile-
Met-Lys-Ser-Leu-Phe-Leu-Ser-Thr-Asn-Met-Gln-Glu-Arg-Leu-Arg-Ser-Lys-Asp-Arg-
Asp-Leu-Gly-Ser-Ser 1739 omega 1 (31,108,138)  0000

1740 omega 1 (102,108,138)  0000

1741 omega 1 (31,102,108,138)  0000

1742 tau

Figure 33 Continued

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1743 tau (31)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1744 tau (102)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1745 tau (108)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1746 tau (138)

Figure 33 Continued

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1747 tau (31,102)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1748 tau (31,108)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1749 tau (31,138)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1750 tau (102,108)

Figure 33 Continued

```
Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg
```

1751 tau (102,138)

```
Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg
```

1752 tau (108,138)

```
Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg
```

1753 tau (31,102,108)

```
Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Leu-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg
```

1754 tau (31,102,138)

Figure 33 Continued

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Glu-Glu-Asn-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1755 tau (31,108,138)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Ile-Ser-Leu-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1756 tau (102,108,138)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Lys-Leu-Ile-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg 1757 tau (31,102,108,138)

Met-Ile-Ile-Lys-His-Phe-Phe-Gly-Thr-Val-Leu-Val-Leu-Leu-Ala-Ser-Thr-Thr-Ile-
Phe-Ser-Leu-Asp-Leu-Asn-Leu-Ser-Ile-Phe-Gln-Gln-Arg-Gln-Val-Asn-Gln-Glu-Ser-
Leu-Lys-Leu-Leu-Asn-Lys-Leu-Gln-Thr-Leu-Ser-Ile-Gln-Gln-Cys-Leu-Pro-His-Arg-
Lys-Asn-Phe-Leu-Leu-Pro-Gln-Lys-Ser-Leu-Ser-Pro-Gln-Gln-Tyr-Gln-Lys-Gly-His-
Thr-Leu-Ala-Ile-Leu-His-Glu-Met-Leu-Gln-Gln-Ile-Phe-Ser-Leu-Phe-Arg-Ala-Asn-
Asn-Ser-Ser-Asp-Gly-Trp-Asn-Glu-Thr-His-Thr-Glu-Lys-Phe-Leu-Ile-Gln-Leu-His-
Gln-Gln-Leu-Glu-Tyr-Leu-Glu-Ala-Leu-Met-Gly-Leu-Glu-Ala-Glu--Lys-Thr-Ser-Gly-
Thr-Leu-Gly-Ser-Asp-Asn-Leu-Arg-Leu-Gln-Val-Lys-Met-Tyr-Phe-Arg-Arg-Ile-His-
Asp-Tyr-Leu-Glu-Asn-Gln-Asp-Tyr-Ser-Thr-Cys-Ala-Trp-Ala-Ile-Val-Gln-Val-Glu-
Ile-Ser-Arg-Cys-Leu-Phe-Phe-Val-Phe-Ser-Leu-Thr-Glu-Lys-Leu-Ser-Lys-Gln-Gly-
Arg-Pro-Leu-Asn-Asp-Met-Lys-Gln-Glu-Leu-Thr-Thr-Glu-Phe-Arg-Ser-Pro-Arg

1758 Infergen

Figure 33 Continued

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1759 Infergen (31)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1760 Infergen (102)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1761 Infergen (108)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1762 Infergen (138)

Figure 33 Continued

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1763 Infergen (31,102)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1764 Infergen (31,108)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1765 Infergen (31,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1766 Infergen (102,108)

Figure 33 Continued

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu
```

1767 Infergen (102,138)

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu
```

1768 Infergen (108,138)

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu
```

1769 Infergen (31,102,108)

```
Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Glu-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu
```

1770 Infergen (31,102,138)

Figure 33 Continued

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asp-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1771 Infergen (31,108,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asp-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1772 Infergen (102,108,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asp-Leu-Pro-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1773 Infergen (31,102,108,138)

Met-Ala-Leu-Pro-Phe-Ala-Leu-Met-Met-Ala-Leu-Val-Val-Leu-Ser-Cys-Lys-Ser-Ser-
Cys-Ser-Leu-Gly-Cys-Asn-Leu-Ser-Gln-Thr-His-Ser-Leu-Gly--Asn-Arg-Arg-Ala-Leu-
Ile-Leu-Leu-Ala-Gln-Met-Arg-Arg-Ile-Ser-Pro-Phe-Ser-Cys-Leu-Lys-Asp-Arg-His-
Asp-Phe-Gly-Phe-Pro-Gln-Glu-Glu-Phe-Asp-Gly-Asn-Gln-Phe-Gln-Lys-Ala-Gln-Ala-
Ile-Ser-Val-Leu-His-Glu-Met-Ile-Gln-Gln-Thr-Phe-Asn-Leu-Phe-Ser-Thr-Lys-Asn-
Ser-Ser-Ala-Ala-Trp-Asn-Glu-Ser-Leu-Leu-Glu-Lys-Phe-Tyr-Thr-Glu-Leu-Tyr-Gln-
Gln-Leu-Asn-Asp-Leu-Glu-Ala-Cys-Val-Ile-Gln-Glu--Val-Gly-Val-Thr-Glu-Thr-Pro-
Leu-Met-Asn-Val-Asp--Ser-Ile-Leu-Ala-Val-Lys-Lys-Tyr-Phe-Gln-Arg-Ile-Thr-Leu-
Tyr-Leu-Thr-Glu-Lys-Lys-Tyr-Ser-Pro-Cys-Ala-Trp-Glu-Val-Val-Arg-Ala-Glu-Ile-
Met-Arg-Ser-Phe-Ser-Leu-Ser-Thr-Asn-Leu-Gln-Glu-Arg-Leu-Arg-Arg-Lys-Glu

1774 DARBEPOETIN ALFA

Figure 33 Continued

```
Ala-Pro-Pro-Arg-Leu-Ile-Cys-Asp-Ser-Arg-Val-Leu-Glu-Arg-Tyr-Leu-Leu-Glu-Ala-
Lys-Glu-Ala-Glu-Asn-Ile-Thr-Thr-Gly-Cys-Asn-Glu-Thr-Cys-Ser-Leu-Asn-Glu-Asn-
Ile-Thr-Val-Pro-Asp-Thr-Lys-Val-Asn-Phe-Tyr-Ala-Trp-Lys-Arg-Met-Glu-Val-Gly-
Gln-Gln-Ala-Val-Glu-Val-Trp-Gln-Gly-Leu-Ala-Leu-Leu-Ser-Glu-Ala-Val-Leu-Arg-
Gly-Gln-Ala-Leu---Asn-Leu-Val-Asn-Ser-Ser-Gln-Val-Asn-Glu-Thr-Leu-Gln-Leu-His-
Val-Asp-Lys-Ala-Val-Ser-Gly-Leu-Arg-Ser-Leu-Thr-Thr-Leu-Leu-Arg-Ala-Leu-Gly-
Ala-Gln-Lys-Glu-Ala-Ile-Ser-Pro-Pro-Asp-Ala-Ala-Ser-Ala-Ala-Pro-Leu-Arg-Thr-
Ile-Thr-Ala-Asp-Thr-Phe-Arg-Lys-Leu-Phe-Arg-Val-Tyr-Ser-Asn-Phe-Leu-Arg-Gly-
Lys-Leu-Lys-Leu-Tyr-Thr-Gly-Glu-Ala---Asn-Cys-Arg-Thr-Gly-Asp-Arg
```

1775 EPOETIN ALFA

```
Ala-Pro-Pro-Arg-Leu-Ile-Cys-Asp-Ser-Arg-Val-Leu-Glu-Arg-Tyr-Leu-Leu-Glu-Ala-
Lys-Glu-Ala-Glu-Asn-Ile-Thr-Thr-Gly-Cys-Ala-Glu-His-Cys-Ser-Leu-Asn-Glu-Asn-
Ile-Thr-Val-Pro-Asp-Thr-Lys-Val-Asn-Phe-Tyr-Ala-Trp-Lys-Arg-Met-Glu-Val-Gly-
Gln-Gln-Ala-Val-Glu-Val-Trp-Gln-Gly-Leu-Ala-Leu-Leu-Ser-Glu-Ala-Val-Leu-Arg-
Gly-Gln-Ala-Leu---Asn-Leu-Val-Asn-Ser-Ser-Gln-Pro-Trp-Glu-Pro-Leu-Gln-Leu-His-
Val-Asp-Lys-Ala-Val-Ser-Gly-Leu-Arg-Ser-Leu-Thr-Thr-Leu-Leu-Arg-Ala-Leu-Gly-
Ala-Gln-Lys-Glu-Ala-Ile-Ser-Pro-Pro-Asp-Ala-Ala-Ser-Ala-Ala-Pro-Leu-Arg-Thr-
Ile-Thr-Ala-Asp-Thr-Phe-Arg-Lys-Leu-Phe-Arg-Val-Tyr-Ser-Asn-Phe-Leu-Arg-Gly-
Lys-Leu-Lys-Leu-Tyr-Thr-Gly-Glu-Ala---Asn-Cys-Arg-Thr-Gly-Asp-Arg
```

1776    0000

1777    0000

1778    0000

1779    0000

1780    0000

1781    0000

1782    0000

1783 alpha 1 (N)

```
ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1784 alpha 1 (31)

Figure 33 Continued

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1785 alpha 1 (102)

ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1786 alpha 1 (108)

ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1787 alpha 1 (138)

ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1788 alpha 1 (31,102)

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1789 alpha 1 (31,108)

Figure 33 Continued

```
ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1790 alpha 1 (31,138)

```
ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1791 alpha 1 (102,108)

```
ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1792 alpha 1 (102,138)

```
ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1793 alpha 1 (108,138)

```
ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1794 alpha 1 (31,102,108)

Figure 33 Continued

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1795 alpha 1 (31,102,138)

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1796 alpha 1 (31,108,138)

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1797 alpha 1 (102,108,138)

ATGGCCTCCCCCTTCGCCCTGCTGATGGTGCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1798 alpha 1 (31,102,108,138)

ATGGCCTCCCCCTTCGCCCTGCTGATGGTGCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1799 alpha 2a (N)

Figure 33 Continued

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1801 alpha 2a (31)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1802 alpha 2a (102)

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1803 alpha 2a (108)

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1804 alpha 2a (138)     0000

1805 alpha 2a (31,102)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1806 alpha 2a (31,108)

Figure 33 Continued

```
ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG
```

1807 alpha 2a (31,138)  0000

1808 alpha 2a (102,108)

```
ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG
```

1809 alpha 2a (102,138)  0000

1810 alpha 2a (108,138)  0000

1811 alpha 2a (31,102,108)

```
ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCAAGATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG
```

1812 alpha 2a (31,102,138)  0000

1813 alpha 2a (31,108,138)  0000

1814 alpha 2a (102,108,138)  0000

1815 alpha 2a (31,102,108,138)  0000

1816 alpha 2b

```
ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG
```

Figure 33 Continued

1817 alpha 2b (31)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1818 alpha 2b (102)

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1819 alpha 2b (108)

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1820 alpha 2b (138)     0000

1821 alpha 2b (31,102)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGGACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1822 alpha 2b (31,108)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGGACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG

Figure 33 Continued 1823 alpha 2b (31,138)    0000

1824 alpha 2b (102,108)

ATGGCCCTGACCTTCGCCCTGCTGGTGGCCCTGCTGGTGCTGTCCTGCAAGTCCTCCTGCTCCGTGGGCTGCGACCTGC
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1825 alpha 2b (102,138)    0000

1826 alpha 2b (108,138)    0000

1827 alpha 2b (31,102,108)

ATGGCCCTGACCTTCGCCCTGCTGGTGGCCCTGCTGGTGCTGTCCTGCAAGTCCTCCTGCTCCGTGGGCTGCAACCTGT
CCCAGACCCACTCCCTGGGCTCCCGCCGCACCCTGATGCTGCTGGCCCAGATGCGCCGCATCTCCCTGTTCTCCTGCCT
GAAGGACCGCCACGACTTCGGCTTCCCCCAGGAGGAGTTCGGCAACCAGTTCCAGAAGGCCGAGACCATCCCCGTGCTG
CACGAGATGATCCAGCAGATCTTCAACCTGTTCTCCACCAAGAACTCCTCCGCCGCCTGGAACGAGACCCTGCTGGACA
AGTTCTACACCGAGCTGTACCAGCAGCTGAACGACCTGGAGGCCTGCGTGATCCAGGGCGTGGGCGTGACCGAGACCCC
CCTGATGAAGGAGGACTCCATCCTGGCCGTGCGCAAGTACTTCCAGCGCATCACCCTGTACCTGAAGGAGAAGAAGTAC
TCCCCCTGCGCCTGGGAGGTGGTGCGCGCCGAGATCATGCGCTCCTTCTCCCTGTCCACCAACCTGCAGGAGTCCCTGC
GCTCCAAGGAG 1828 alpha 2b (31,102,138)    0000

1829 alpha 2b (31,108,138)    0000

1830 alpha 2b (102,108,138)    0000

1831 alpha 2b (31,102,108,138)    0000

1832 alpha 4a

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1833 alpha 4a (31)

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1834 alpha 4a (102)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1835 alpha 4a (108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1836 alpha 4a (138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1837 alpha 4a (31,102)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1838 alpha 4a (31,108)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1839 alpha 4a (31,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1840 alpha 4a (102,108)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1841 alpha 4a (102,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1842 alpha 4a (108,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1843 alpha 4a (31,102,108)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1844 alpha 4a (31,102,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1845 alpha 4a (31,108,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1846 alpha 4a (102,108,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1847 alpha 4a (31,102,108,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1848 alpha 4b

Figure 33 Continued

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1849 alpha 4b (31)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1850 alpha 4b (102)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1851 alpha 4b (108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1852 alpha 4b (138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1853 alpha 4b (31,102)

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1854 alpha 4b (31,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1855 alpha 4b (31,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1856 alpha 4b (102,108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1857 alpha 4b (102,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1858 alpha 4b (108,138)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1859  alpha 4b  (31,102,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1860  alpha 4b  (31,102,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1861  alpha 4b  (31,108,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1862  alpha 4b  (102,108,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1863  alpha 4b  (31,102,108,138)
```

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCCACGACTTCGGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1864 alpha 5

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1865 alpha 5 (31)

```
ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1866 alpha 5 (102)

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1867 alpha 5 (108)

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1868 alpha 5 (138)

Figure 33 Continued

ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG 1869 alpha 5 (31,102)

ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGAACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG 1870 alpha 5 (31,108)

ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG 1871 alpha 5 (31,138)

ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG 1872 alpha 5 (102,108)

ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG 1873 alpha 5 (102,138)

Figure 33 Continued

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1874 alpha 5 (108,138)

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1875 alpha 5 (31,102,108)

```
ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGGAGGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1876 alpha 5 (31,102,138)

```
ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGGACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1877 alpha 5 (31,108,138)

```
ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1878 alpha 5 (102,108,138)

Figure 33 Continued

```
ATGGCCCTGCCCTTCGTGCTGCTGATGGCCCTGGTGGTGCTGAACTGCAAGTCCATCTGCTCCCTGGGCTGCGACCTGC
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1879 alpha 5 (31,102,108,138)

```
ATGGCCCTGCCCTTCGTGCTGCTGATGGCCCTGGTGGTGCTGAACTGCAAGTCCATCTGCTCCCTGGGCTGCAACCTGT
CCCAGACCCACTCCCTGTCCAACCGCCGCACCCTGATGATCATGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACGAGACCCTGCTGG
ACAAGTTCTACACCGAGCTGTACCAGCAGCTGAACGACCTGGAGGCCTGCATGATGCAGGAGGTGGGCGTGACCGACAC
CCCCCTGATGAACGTGGACTCCATCCTGACCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCGCCAACCTGCAGGAGCGCC
TGCGCCGCAAGGAG
```

1880 alpha 6

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1881 alpha 6 (31)

```
ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1882 alpha 6 (102)

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1883 alpha 6 (108)

Figure 33 Continued

ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG 1884 alpha 6 (138)

ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG 1885 alpha 6 (31,102)

ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG 1886 alpha 6 (31,108)

ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG 1887 alpha 6 (31,138)

ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG 1888 alpha 6 (102,108)

Figure 33 Continued

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1889 alpha 6 (102,138)

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1890 alpha 6 (108,138)

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1891 alpha 6 (31,102,108)

```
ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGGGCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1892 alpha 6 (31,102,138)

```
ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGGACGAGCGCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1893 alpha 6 (31,108,138)

Figure 33 Continued

```
ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGGACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1894 alpha 6 (102,108,138)

```
ATGGCCCTGCCCTTCGCCCTGCTGATGGCCCTGGTGGTGCTGTCCTGCAAGTCCTCCTGCTCCCTGGACTGCGACCTGC
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1895 alpha 6 (31,102,108,138)

```
ATGGCCCTGCCCTTCGCCCTGCTGATGGCCCTGGTGGTGCTGTCCTGCAAGTCCTCCTGCTCCCTGGACTGCAACCTGT
CCCAGACCCACTCCCTGGGCCACCGCCGCACCATGATGCTGCTGGCCCAGATGCGCCGCATCTCCCTGTTCTCCTGCCT
GAAGGACCGCCACGACTTCCGCTTCCCCCAGGAGGAGTTCGACGGCAACCAGTTCCAGAAGGCCGAGGCCATCTCCGTG
CTGCACGAGGTGATCCAGCAGACCTTCAACCTGTTCTCCACCAAGAACTCCTCCGTGGCCTGGAACGAGACCCTGCTGG
ACAAGCTGTACACCGAGCTGTACCAGCAGCTGAACGACCTGGAGGCCTGCGTGATGCAGGAGGTGTGGGTGACCGGCAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTCCTCCCGCAACCTGCAGGAGCGCC
TGCGCCGCAAGGAG
```

1896 alpha 7

```
ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1897 alpha 7 (31)

```
ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1898 alpha 7 (102)

Figure 33 Continued

```
ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1899 alpha 7 (108)

```
ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1900 alpha 7 (138)

```
ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1901 alpha 7 (31,102)

```
ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1902 alpha 7 (31,108)

```
ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

1903 alpha 7 (31,138)

Figure 33 Continued

ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1904 alpha 7 (102,108)

ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1905 alpha 7 (102,138)

ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1906 alpha 7 (108,138)

ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1907 alpha 7 (31,102,108)

ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1908 alpha 7 (31,102,138)

Figure 33 Continued

ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1909 alpha 7 (31,108,138)

ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1910 alpha 7 (102,108,138)

ATGGCCCGCTCCTTCTCCCTGCTGATGGTGGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1911 alpha 7 (31,102,108,138)

ATGGCCCGCTCCTTCTCCCTGCTGATGGTGGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 1912 alpha 8

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1913 alpha 8 (31)

Figure 33 Continued

ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1914 alpha 8 (102)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1915 alpha 8 (108)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1916 alpha 8 (138)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1917 alpha 8 (31,102)

ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1918 alpha 8 (31,108)

Figure 33 Continued

ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1919 alpha 8 (31,138)

ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1920 alpha 8 (102,108)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGAACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1921 alpha 8 (102,138)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGAACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1922 alpha 8 (108,138)

ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG 1923 alpha 8 (31,102,108)

Figure 33 Continued

```
ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGATCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG
```

1924 alpha 8 (31,102,138)

```
ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGGACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG
```

1925 alpha 8 (31,108,138)

```
ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGGACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG
```

1926 alpha 8 (102,108,138)

```
ATGGCCCTGACCTTCTACCTGCTGGTGGCCCTGGTGGTGCTGTCCTACAAGTCCTTCTCCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG
```

1927 alpha 8 (31,102,108,138)

```
ATGGCCCTGACCTTCTACCTGCTGGTGGCCCTGGTGGTGCTGTCCTACAAGTCCTTCTCCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGAGTTCCCCCAGGAGGAGTTCGACGACAAGCAGTTCCAGAAGGCCCAGGCCATCTCCGTG
CTGCACGAGATGATCCAGCAGACCTTCAACCTGTTCTCCACCAAGAACTCCTCCGCCGCCCTGAACGAGACCCTGCTGG
ACGAGTTCTACATCGAGCTGGACCAGCAGCTGAACGACCTGGAGTCCTGCGTGATGCAGGAGGTGGGCGTGACCGAGTC
CCCCCTGATGTACGAGGACTCCATCCTGGCCGTGCGCAAGTACTTCCAGCGCATCACCCTGTACCTGACCGAGAAGAAG
TACTCCTCCTGCGCCTGGGAGGTGGTGCGCGCCGAGATCATGCGCTCCTTCTCCCTGTCCATCAACCTGCAGAAGCGCC
TGAAGTCCAAGGAG
```

1928 alpha 10

Figure 33 Continued

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1929 alpha 10 (31)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1930 alpha 10 (102)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1931 alpha 10 (108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1932 alpha 10 (138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1933 alpha 10 (31,102)

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1934 alpha 10 (31,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1935 alpha 10 (31,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1936 alpha 10 (102,108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1937 alpha 10 (102,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1938 alpha 10 (108,138)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1939 alpha 10 (31,102,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1940 alpha 10 (31,102,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1941 alpha 10 (31,108,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1942 alpha 10 (102,108,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 1943 alpha 10 (31,102,108,138)
```

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGGCCAGATGGGCCGCATCTCCCCCTTCTCCTGCCT
GAAGGACCGCCACGACTTCCGCATCCCCCAGGAGGAGTTCGACGGCAACCAGTTCCAGAAGGCCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTCCATCCTGGCCGTGCGCAAGTACTTCCAGCGCATCACCCTGTACCTGATCGAGCGCAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

1944 alpha 13

```
ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1945 alpha 13 (31)

```
ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1946 alpha 13 (102)

```
ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1947 alpha 13 (108)

```
ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1948 alpha 13 (138)

Figure 33 Continued

ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1949 alpha 13 (31,102)

ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1950 alpha 13 (31,108)

ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1951 alpha 13 (31,138)

ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1952 alpha 13 (102,108)

ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1953 alpha 13 (102,138)

Figure 33 Continued

```
ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1954 alpha 13 (108,138)

```
ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1955 alpha 13 (31,102,108)

```
ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGGGCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1956 alpha 13 (31,102,138)

```
ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGGACGAGGACCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1957 alpha 13 (31,108,138)

```
ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGGACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG
```

1958 alpha 13 (102,108,138)

Figure 33 Continued

ATGGCCTCCCCCTTCGCCCTGCTGATGGCCCTGGTGGTGCTGTCCTGCAAGTCCTCCTGCTCCCTGGGCTGCGACCTGC
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1959 alpha 13 (31,102,108,138)

ATGGCCTCCCCCTTCGCCCTGCTGATGGCCCTGGTGGTGCTGTCCTGCAAGTCCTCCTGCTCCCTGGGCTGCAACCTGT
CCGAGACCCACTCCCTGGACAACCGCCGCACCCTGATGCTGCTGGCCCAGATGTCCCGCATCTCCCCCTCCTCCTGCCT
GATGGACCGCCACGACTTCGGCTTCCCCCAGGAGGAGTTCGACGGCAACCAGTTCCAGAAGGCCCCCGCCATCTCCGTG
CTGCACGAGCTGATCCAGCAGATCTTCAACCTGTTCACCACCAAGAACTCCTCCGCCGCCTGGAACGAGACCCTGCTGG
ACAAGTTCTGCACCGAGCTGTACCAGCAGCTGAACGACCTGGAGGCCTGCGTGATGCAGGAGGAGCGCGTGACCGAGAC
CCCCCTGATGAACGCCGACTCCATCCTGGCCGTGAAGAAGTACTTCCGCCGCATCACCCTGTACCTGACCGAGAAGAAG
TACTCCCCCTGCGCCTGGGAGGTGGTGCGCGCCGAGATCATGCGCTCCCTGTCCCTGTCCACCAACCTGCAGGAGCGCC
TGCGCCGCAAGGAG 1960 alpha 14

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGGACGAGACCCTGCTGG
AGAAGTTCTACATCGAGCTGTTCCAGCAGATGAACGACCTGGAGGCCTGCGTGATCCAGGAGGTGGGCGTGGAGGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGCAGAAGCGCC
TGCGCCGCAAGGAC 1961 alpha 14 (31)    0000

1962 alpha 14 (102)    0000

1963 alpha 14 (108)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGAACGAGACCCTGCTGG
AGAAGTTCTACATCGAGCTGTTCCAGCAGATGAACGACCTGGAGGCCTGCGTGATCCAGGAGGTGGGCGTGGAGGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGCAGAAGCGCC
TGCGCCGCAAGGAC 1964 alpha 14 (138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGGACGAGACCCTGCTGG
AGAAGTTCTACATCGAGCTGTTCCAGCAGATGAACGACCTGGAGGCCTGCGTGATCCAGGAGGTGGGCGTGGACCGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGCAGAAGCGCC
TGCGCCGCAAGGAC

Figure 33 Continued 1965 alpha 14 (31,102)    0000

1966 alpha 14 (31,108)    0000

1967 alpha 14 (31,138)    0000

1968 alpha 14 (102,108)   0000

1969 alpha 14 (102,138)   0000

1970 alpha 14 (108,138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGAACGAGACCCTGCTGG
AGAAGTTCTACATCGAGCTGTTCCAGCAGATGAACGACCTGGAGGCCTGCGTGATCCAGGAGGTGGGCGTGACCGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCTTCTCCTTCTCCACCAACCTGCAGAAGCGCC
TGCGCCGCAAGGAC 1971 alpha 14 (31,102,108)    0000

1972 alpha 14 (31,102,138)    0000

1973 alpha 14 (31,108,138)    0000

1974 alpha 14 (102,108,138)   0000

1975 alpha 14 (31,102,108,138) 0000

1976 alpha 16

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1977 alpha 16 (31)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1978 alpha 16 (102)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1979 alpha 16 (108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1980 alpha 16 (138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1981 alpha 16 (31,102)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1982 alpha 16 (31,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1983 alpha 16 (31,138)
```

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1984 alpha 16 (102,108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1985 alpha 16 (102,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1986 alpha 16 (108,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1987 alpha 16 (31,102,108)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGGAGGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC 1988 alpha 16 (31,102,138)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGGACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC
```

1989 alpha 16 (31,108,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGGACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC
```

1990 alpha 16 (102,108,138)

```
ATGGCCCTGTCCTTCTCCCTGCTGATGGCCGTGCTGGTGCTGTCCTACAAGTCCATCTGCTCCCTGGGCTGCGACCTGC
CCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC
```

1991 alpha 16 (31,102,108,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCACTTCTCCTGCCT
GAAGGACCGCTACGACTTCGGCTTCCCCCAGGAGGTGTTCGACGGCAACCAGTTCCAGAAGGCCCAGGCCATCTCCGCC
TTCCACGAGATGATCCAGCAGACCTTCAACCTGTTCTCCACCAAGAACTCCTCCGCCGCCTGGAACGAGACCCTGCTGG
ACAAGTTCTACATCGAGCTGTTCCAGCAGCTGAACGACCTGGAGGCCTGCGTGACCCAGGAGGTGGGCGTGACCGAGAT
CGCCCTGATGAACGAGGACTCCATCCTGGCCGTGCGCAAGTACTTCCAGCGCATCACCCTGTACCTGATGGGCAAGAAG
TACTCCCCCTGCGCCTGGGAGGTGGTGCGCGCCGAGATCATGCGCTCCTTCTCCTTCTCCACCAACCTGCAGAAGGGCC
TGCGCCGCAAGGAC
```

1992 alpha 17

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

1993 alpha 17 (31)

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 1994 alpha 17 (102)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 1995 alpha 17 (108)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 1996 alpha 17 (138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 1997 alpha 17 (31,102)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 1998 alpha 17 (31,108)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

1999 alpha 17 (31,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2000 alpha 17 (102,108)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2001 alpha 17 (102,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2002 alpha 17 (108,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2003 alpha 17 (31,102,108)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2004 alpha 17 (31,102,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2005 alpha 17 (31,108,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2006 alpha 17 (102,108,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2007 alpha 17 (31,102,108,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2008 alpha 21
```

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2009 alpha 21 (31)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2010 alpha 21 (102)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2011 alpha 21 (108)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAACCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2012 alpha 21 (138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2013 alpha 21 (31,102)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2014 alpha 21 (31,108)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2015 alpha 21 (31,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2016 alpha 21 (102,108)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2017 alpha 21 (102,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2018 alpha 21 (108,138)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2019 alpha 21 (31,102,108)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2020 alpha 21 (31,102,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGGAGCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2021 alpha 21 (31,108,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2022 alpha 21 (102,108,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2023 alpha 21 (31,102,108,138)

Figure 33 Continued

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCACCTGGAACCAGTCCCTGCTGG
AGAAGTTCTCCACCGAGCTGAACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCAAGATCTTCCAGGAGCGCC
TGCGCCGCAAGGAG
```

2024 alpha H

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGGACGAGACCCTGCTGG
AGAAGTTCTACATCGAGCTGTTCCAGCAGATGAACGACCTGGAGGCCTGCGTGATCCAGGAGGTGGGCGTGGAGGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

2025 alpha H (31)    0000

2026 alpha H (102)    0000

2027 alpha H (108)

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGAACGAGACCCTGCTGG
AGAAGTTCTACATCGAGCTGTTCCAGCAGATGAACGACCTGGAGGCCTGCGTGATCCAGGAGGTGGGCGTGGAGGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

2028 alpha H (138)

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGGACGAGACCCTGCTGG
AGAAGTTCTACATCGAGCTGTTCCAGCAGATGAACGACCTGGAGGCCTGCGTGATCCAGGAGGTGGGCGTGACCGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC
```

2029 alpha H (31,102)    0000

2030 alpha H (31,108)    0000

2031 alpha H (31,138)    0000

2032 alpha H (102,108)    0000

2033 alpha H (102,138)    0000

Figure 33 Continued 2034 alpha H (108,138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGAACAACCGCCGCACCCTGATGCTGATGGCCCAGATGCGCCGCATCTCCCCCTTCTCCTGCCT
GAAGGACCGCCACGACTTCGAGTTCCCCCAGGAGGAGTTCGACGGCAACCAGTTCCAGAAGGCCCAGGCCATCTCCGTG
CTGCACGAGATGATGCAGCAGACCTTCAACCTGTTCTCCACCAAGAACTCCTCCGCCGCCTGGAACGAGACCCTGCTGG
AGAAGTTCTACATCGAGCTGTTCCAGCAGATGAACGACCTGGAGGCCTGCGTGATCCAGGAGGTGGGCGTGACCGAGAC
CCCCCTGATGAACGAGGACTCCATCCTGGCCGTGAAGAAGTACTTCCAGCGCATCACCCTGTACCTGATGGAGAAGAAG
TACTCCCCCTGCGCCTGGGAGGTGGTGCGCGCCGAGATCATGCGCTCCCTGTCCTTCTCCACCAACCTGCAGAAGCGCC
TGCGCCGCAAGGAC 2035 alpha H (31,102,108)   0000

2036 alpha H (31,102,138)   0000

2037 alpha H (31,108,138)   0000

2038 alpha H (102,108,138)  0000

2039 alpha H (31,102,108,138) 0000

2040 alpha I

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2041 alpha I (31)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2042 alpha I (102)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2043 alpha I (108)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2044 alpha I (138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2045 alpha I (31,102)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2046 alpha I (31,108)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2047 alpha I (31,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2048 alpha I (102,108)

Figure 33 Continued

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2049 alpha I (102,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2050 alpha I (108,138)

```
ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2051 alpha I (31,102,108)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGGAGGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2052 alpha I (31,102,138)

```
ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC
```

2053 alpha I (31,108,138)

Figure 33 Continued

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2054 alpha I (102,108,138)

ATGGCCCTGTCCTTCTCCCTGCTGATGGCCGTGCTGGTGCTGTCCTACAAGTCCATCTGCTCCCTGGGCTGCGACCTGC
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2055 alpha I (31,102,108,138)

ATGGCCCTGTCCTTCTCCCTGCTGATGGCCGTGCTGGTGCTGTCCTACAAGTCCATCTGCTCCCTGGGCTGCAACCTGT
CCCAGACCCACTCCCTGGGCAACCGCCGCGCCCTGATCCTGCTGGCCCAGATGGGCCGCATCTCCCCCTTCTCCTGCCT
GAAGGACCGCCCCGACTTCGGCCTGCCCCAGGAGGAGTTCGACGGCAACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACAACCTGGAGGCCTGCGTGATCCAGGAGGTGGGCATGACCGAGAC
CCCCCTGATGAACGAGGACTCCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCCTGTCCTTCTCCACCAACCTGCAGAAGATCC
TGCGCCGCAAGGAC 2056 alpha J1

ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2057 alpha J1 (31)

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2058 alpha J1 (102)

Figure 33 Continued

```
ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

2059 alpha J1 (108)

```
ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

2060 alpha J1 (138)

```
ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

2061 alpha J1 (31,102)

```
ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

2062 alpha J1 (31,108)

```
ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC
```

2063 alpha J1 (31,138)

Figure 33 Continued

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2064 alpha J1 (102,108)

ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2065 alpha J1 (102,138)

ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2066 alpha J1 (108,138)

ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2067 alpha J1 (31,102,108)

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGGAGGAGAC
CCCCCTGATGAACGAGGACTTCATCCTGGCCGTGCGCAAGTACTTCCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2068 alpha J1 (31,102,138)

Figure 33 Continued

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGGAGCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2069 alpha J1 (31,108,138)

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGGACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2070 alpha J1 (102,108,138)

ATGGCCCGCTCCTTCTCCCTGCTGATGGCCGTGCTGGTGCTGTCCTACAAGTCCATCTGCTCCCTGGGCTGCGACCTGC
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2071 alpha J1 (31,102,108,138)

ATGGCCCGCTCCTTCTCCCTGCTGATGGCCGTGCTGGTGCTGTCCTACAAGTCCATCTGCTCCCTGGGCTGCAACCTGT
CCCAGACCCACTCCCTGCGCAACCGCCGCGCCCTGATCCTGCTGGCCCAGATGGGCCGCATCTCCCCCTTCTCCTGCCT
GAAGGACCGCCACGAGTTCCGCTTCCCCGAGGAGGAGTTCGACGGCCACCAGTTCCAGAAGACCCAGGCCATCTCCGTG
CTGCACGAGATGATCCAGCAGACCTTCAACCTGTTCTCCACCGAGAACTCCTCCGCCGCCTGGAACCAGTCCCTGCTGG
AGAAGTTCTCCACCGAGCTGTACCAGCAGCTGAACGACCTGGAGGCCTGCGTGATCCAGGAGGTGGGCGTGACCGAGAC
CCCCCTGATGAACGAGGACTTCATCCTGGCCGTGCGCAAGTACTTCAGCGCATCACCCTGTACCTGACCGAGAAGAAG
TACTCCCCCTGCGCCTGGGAGGTGGTGCGCGCCGAGATCATGCGCTCCTTCTCCTTCTCCACCAACCTGAAGAAGGGCC
TGCGCCGCAAGGAC 2072 beta 1

ATGACCAACAAGTGCCTGCTGCAGATCGCCCTGCTGCTGTGCTTCTCCACCACCGCCCTGTCCATGTCCTACAACCTGC
TGGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACTCCTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGGAGGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC 2073 beta 1 (31)

Figure 33 Continued

```
ATGACCAACAAGTGCCTGCTGCAGATCGCCCTGCTGCTGTGCTTCTCCACCACCGCCCTGTCCATGTCCTACAACCTGT
CCGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACTCCTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGGAGGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC
```

2074 beta 1 (102)

```
ATGACCAACAAGTGCCTGCTGCAGATCGCCCTGCTGCTGTGCTTCTCCACCACCGCCCTGTCCATGTCCTACAACCTGC
TGGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACAACTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGGAGGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC
```

2075 beta 1 (108)    0000

2076 beta 1 (138)

```
ATGACCAACAAGTGCCTGCTGCAGATCGCCCTGCTGCTGTGCTTCTCCACCACCGCCCTGTCCATGTCCTACAACCTGC
TGGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACTCCTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGACCGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC
```

2077 beta 1 (31,102)

```
ATGACCAACAAGTGCCTGCTGCAGATCGCCCTGCTGCTGTGCTTCTCCACCACCGCCCTGTCCATGTCCTACAACCTGT
CCGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACAACTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGGAGGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC
```

2078 beta 1 (31,108)    0000

2079 beta 1 (31,138)

```
ATGACCAACAAGTGCCTGCTGCAGATCGCCCTGCTGCTGTGCTTCTCCACCACCGCCCTGTCCATGTCCTACAACCTGT
CCGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACTCCTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGACCGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC
```

Figure 33 Continued 2080 beta 1 (102,108)    0000

2081 beta 1 (102,138)

ATGACCAACAAGTGCCTGCTGCAGATCGCCCTGCTGCTGTGCTTCTCCACCACCGCCCTGTCCATGTCCTACAACCTGC
TGGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACAACTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGACCGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC 2082 beta 1 (108,138)    0000

2083 beta 1 (31,102,108)    0000

2084 beta 1 (31,102,138)

ATGACCAACAAGTGCCTGCTGCAGATCGCCCTGCTGCTGTGCTTCTCCACCACCGCCCTGTCCATGTCCTACAACCTGT
CCGGCTTCCTGCAGCGCTCCTCCAACTTCCAGTGCCAGAAGCTGCTGTGGCAGCTGAACGGCCGCCTGGAGTACTGCCT
GAAGGACCGCATGAACTTCGACATCCCCGAGGAGATCAAGCAGCTGCAGCAGTTCCAGAAGGAGGACGCCGCCCTGACC
ATCTACGAGATGCTGCAGAACATCTTCGCCATCTTCCGCCAGGACAACTCCTCCACCGGCTGGAACGAGACCATCGTGG
AGAACCTGCTGGCCAACGTGTACCACCAGATCAACCACCTGAAGACCGTGCTGGAGGAGAAGCTGGAGAAGACCGACTT
CACCCGCGGCAAGCTGATGTCCTCCCTGCACCTGAAGCGCTACTACGGCCGCATCCTGCACTACCTGAAGGCCAAGGAG
TACTCCCACTGCGCCTGGACCATCGTGCGCGTGGAGATCCTGCGCAACTTCTACTTCATCAACCGCCTGACCGGCTACC
TGCGCAAC 2085 beta 1 (31,108,138)    0000

2086 beta 1 (102,108,138)    0000

2087 beta 1 (31,102,108,138)    0000

2088 kappa

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2089 kappa (31)

ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG

Figure 33 Continued 2090 kappa (102)

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2091 kappa (108)

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2092 kappa (138)

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2093 kappa (31,102)

ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2094 kappa (31,108)

ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2095 kappa (31,138)

Figure 33 Continued

```
ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG
```

2096 kappa (102,108)

```
ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG
```

2097 kappa (102,138)

```
ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG
```

2098 kappa (108,138)

```
ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACACCTTCAAGTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG
```

2099 kappa (31,102,108)

```
ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGCCCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG
```

2100 kappa (31,102,138)

Figure 33 Continued

ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2101 kappa (31,108,138)

ATGTCCACCAAGCCCGACATGATCCAGAAGTGCCTGTGGCTGGAGATCCTGATGGGCATCTTCATCGCCGGCACCCTGT
CCCTGGACTGCAACCTGTCCAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAAGGAGCGCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2102 kappa (102,108,138)

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAACGAGACCCACCTGAAGCAGATCCAGATCGGCCTGGACCAGCAGGCCGAGTACCTGAACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2103 kappa (31,102,108,138)

ATGTCCACCAAGCCCGACATGATCCAGAAGTGCCTGTGGCTGGAGATCCTGATGGGCATCTTCATCGCCGGCACCCTGT
CCCTGGACTGCAACCTGCTGAACGTGCACCTGCGCCGCGTGACCTGGCAGAACCTGCGCCACCTGTCCTCCATGTCCAA
CTCCTTCCCCGTGGAGTGCCTGCGCGAGAACATCGCCTTCGAGCTGCCCCAGGAGTTCCTGCAGTACACCCAGCCCATG
AAGCGCGACATCAAGAAGGCCTTCTACGAGATGTCCCTGCAGGCCTTCAACATCTTCTCCCAGCACAACTTCTCCTACT
GGAACGAGACCCACCTGAAGCAGATCCAGATCGGCCTGGACCAGCAGGCCGAGTACCAGTGCCTGGAGGAGGA
CGAGAACGAGAACGAGGACATGAAGGAGATGAAGGAGAACGAGATGAAGACCTCCGAGGCCCGCGTGCCCCAGCTGTCC
TCCCTGGAGCTGCGCCGCTACTTCCACCGCATCGACAACTTCCTGAAGGAGAAGAAGTACTCCGACTGCGCCTGGGAGA
TCGTGCGCGTGGAGATCCGCCGCTGCCTGTACTACTTCTACAAGTTCACCGCCCTGTTCCGCCGCAAG 2104 omega 1

ATGGCCCTGCTGTTCCCCCTGCTGGCCGCCCTGGTGATGACCTCCTACTCCCCCGTGGGCTCCCTGGGCTGCGACCTGC
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGCGCTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGGGCGAGTC
CGCCGGCGCCATCTCCTCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2105 omega 1 (31)

Figure 33 Continued

```
ATGGCCCTGCTGTTCCCCCTGCTGGCCGCCCTGGTGATGACCTCCTACTCCCCCGTGGGCTCCCTGGGCTGCAACCTGT
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGCGCTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGGGCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2106 omega 1 (102)

ATGGCCCTGCTGTTCCCCCTGCTGGCCGCCCTGGTGATGACCTCCTACTCCCCCGTGGGCTCCCTGGGCTGCGACCTGC
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGAACTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGGGCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2107 omega 1 (108)    0000

2108 omega 1 (138)

ATGGCCCTGCTGTTCCCCCTGCTGGCCGCCCTGGTGATGACCTCCTACTCCCCCGTGGGCTCCCTGGGCTGCGACCTGC
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGCGCTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGACCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2109 omega 1 (31,102)

ATGGCCCTGCTGTTCCCCCTGCTGGCCGCCCTGGTGATGACCTCCTACTCCCCCGTGGGCTCCCTGGGCTGCAACCTGT
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGAACTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGGGCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2110 omega 1 (31,108)    0000

2111 omega 1 (31,138)

ATGGCCCTGCTGTTCCCCCTGCTGGCCGCCCTGGTGATGACCTCCTACTCCCCCGTGGGCTCCCTGGGCTGCAACCTGT
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGCGCTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGACCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC
```

Figure 33 Continued 2112 omega 1 (102,108)    0000

2113 omega 1 (102,138)

ATGGCCCTGCTGTTCCCCCTGCTGGCCGCCCTGGTGATGACCTCCTACTCCCCCGTGGGCTCCCTGGGCTGCGACCTGC
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGAACTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGACCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2114 omega 1 (108,138)    0000

2115 omega 1 (31,102,108)    0000

2116 omega 1 (31,102,138)

ATGGCCCTGCTGTTCCCCCTGCTGGCCGCCCTGGTGATGACCTCCTACTCCCCCGTGGGCTCCCTGGGCTGCAACCTGT
CCCAGAACCACGGCCTGCTGTCCCGCAACACCCTGGTGCTGCTGCACCAGATGCGCCGCATCTCCCCCTTCCTGTGCCT
GAAGGACCGCCGCGACTTCCGCTTCCCCCAGGAGATGGTGAAGGGCTCCCAGCTGCAGAAGGCCCACGTGATGTCCGTG
CTGCACGAGATGCTGCAGCAGATCTTCTCCCTGTTCCACACCGAGAACTCCTCCGCCGCCTGGAACATGACCCTGCTGG
ACCAGCTGCACACCGGCCTGCACCAGCAGCTGCAGCACCTGGAGACCTGCCTGCTGCAGGTGGTGGGCGAGACCGAGTC
CGCCGGCGCCATCTCCTCCCCCGCCCTGACCCTGCGCCGCTACTTCCAGGGCATCCGCGTGTACCTGAAGGAGAAGAAG
TACTCCGACTGCGCCTGGGAGGTGGTGCGCATGGAGATCATGAAGTCCCTGTTCCTGTCCACCAACATGCAGGAGCGCC
TGCGCTCCAAGGACCGCGACCTGGGCTCCTCC 2117 omega 1 (31,108,138)    0000

2118 omega 1 (102,108,138)    0000

2119 omega 1 (31,102,108,138)    0000

2120 tau

ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2121 tau (31)

ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC

Figure 33 Continued 2122 tau (102)

ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2123 tau (108)

ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGAACGAGACCCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2124 tau (138)

ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2125 tau (31,102)

ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2126 tau (31,108)

ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGAACGAGACCCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC 2127 tau (31,138)

Figure 33 Continued

```
ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2128 tau (102,108)

```
ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGAACGAGACCCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2129 tau (102,138)

```
ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2130 tau (108,138)

```
ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACATCTCCCTGGACGGCTGGAACGAGACCCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2131 tau (31,102,108)

```
ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGAACGAGACCCACA
CCGAGAAGTTCCTGATCCAGCTGCACCAGCAGCTGGAGTACCTGGAGGCCCTGATGGGCCTGGAGGCCGAGAAGCTGTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2132 tau (31,102,138)

Figure 33 Continued

```
ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGGAGGAGAACCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2133 tau (31,108,138)

```
ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGAACGAGACCCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2134 tau (102,108,138)

```
ATGATCATCAAGCACTTCTTCGGCACCGTGCTGGTGCTGCTGGCCTCCACCACCATCTTCTCCCTGGACCTGAAGCTGA
TCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGAACGAGACCCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2135 tau (31,102,108,138)

```
ATGATCATCAAGCACTTCTTCGGCACCGTGCTGGTGCTGCTGGCCTCCACCACCATCTTCTCCCTGGACCTGAACCTGT
CCATCTTCCAGCAGCGCCAGGTGAACCAGGAGTCCCTGAAGCTGCTGAACAAGCTGCAGACCCTGTCCATCCAGCAGTG
CCTGCCCCACCGCAAGAACTTCCTGCTGCCCCAGAAGTCCCTGTCCCCCCAGCAGTACCAGAAGGGCCACACCCTGGCC
ATCCTGCACGAGATGCTGCAGCAGATCTTCTCCCTGTTCCGCGCCAACAACTCCTCCGACGGCTGGAACGAGACCCACA
CCGAGAAGTTCCTGATCCAGCTGCACCAGCAGCTGGAGTACCTGGAGGCCCTGATGGGCCTGGAGGCCGAGAAGACCTC
CGGCACCCTGGGCTCCGACAACCTGCGCCTGCAGGTGAAGATGTACTTCCGCCGCATCCACGACTACCTGGAGAACCAG
GACTACTCCACCTGCGCCTGGGCCATCGTGCAGGTGGAGATCTCCCGCTGCCTGTTCTTCGTGTTCTCCCTGACCGAGA
AGCTGTCCAAGCAGGGCCGCCCCCTGAACGACATGAAGCAGGAGCTGACCACCGAGTTCCGCTCCCCCCGC
```

2136 Infergen

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2137 Infergen (31)

Figure 33 Continued

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2138 Infergen (102)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2139 Infergen (108)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2140 Infergen (138)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2141 Infergen (31,102)

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2142 Infergen (31,108)

Figure 33 Continued

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2143 Infergen (31,138)

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2144 Infergen (102,108)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2145 Infergen (102,138)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGGACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2146 Infergen (108,138)

```
ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG
```

2147 Infergen (31,102,108)

Figure 33 Continued

```
ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGGAGGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG

2148 Infergen (31,102,138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG

2149 Infergen (31,108,138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGGACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG

2150 Infergen (102,108,138)

ATGGCCCTGCCCTTCGCCCTGATGATGGCCCTGGTGGTGCTGTCCTGCAAGTCCTCCTGCTCCCTGGGCTGCGACCTGC
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG

2151 Infergen (31,102,108,138)

ATGGCCCTGCCCTTCGCCCTGATGATGGCCCTGGTGGTGCTGTCCTGCAAGTCCTCCTGCTCCCTGGGCTGCAACCTGT
CCCAGACCCACTCCCTGGGCAACCGCCGCGCCCTGATCCTGCTGGCCCAGATGCGCCGCATCTCCCCCTTCTCCTGCCT
GAAGGACCGCCACGACTTCGGCTTCCCCCAGGAGGAGTTCGACGGCAACCAGTTCCAGAAGGCCCAGGCCATCTCCGTG
CTGCACGAGATGATCCAGCAGACCTTCAACCTGTTCTCCACCAAGAACTCCTCCGCCGCCTGGAACGAGTCCCTGCTGG
AGAAGTTCTACACCGAGCTGTACCAGCAGCTGAACGACCTGGAGGCCTGCGTGATCCAGGAGGTGGGCGTGACCGAGAC
CCCCCTGATGAACGTGGACTCCATCCTGGCCGTGAAGAAGTACTTCCAGCGCATCACCCTGTACCTGACCGAGAAGAAG
TACTCCCCCTGCGCCTGGGAGGTGGTGCGCGCCGAGATCATGCGCTCCTTCTCCCTGTCCACCAACCTGCAGGAGCGCC
TGCGCCGCAAGGAG

2152 DARBEPOETIN ALFA
```

Figure 33 Continued

```
GCCCCCCCCCGCCTGATCTGCGACTCCCGCGTGCTGGAGCGCTACCTGCTGGAGGCCAAGGAGGCCGAGAACATCACCA
CCGGCTGCAACGAGACCTGCTCCCTGAACGAGAACATCACCGTGCCCGACACCAAGGTGAACTTCTACGCCTGGAAGCG
CATGGAGGTGGGCCAGCAGGCCGTGGAGGTGTGGCAGGGCCTGGCCCTGCTGTCCGAGGCCGTGCTGCGCGGCCAGGCC
CTGCTGGTGAACTCCTCCCAGGTGAACGAGACCCTGCAGCTGCACGTGGACAAGGCCGTGTCCGGCCTGCGCTCCCTGA
CCACCCTGCTGCGCGCCCTGGGCGCCCAGAAGGAGGCCATCTCCCCCCCCGACGCCGCCTCCGCCGCCCCCTGCGCAC
CATCACCGCCGACACCTTCCGCAAGCTGTTCCGCGTGTACTCCAACTTCCTGCGCGGCAAGCTGAAGCTGTACACCGGC
GAGGCCTGCCGCACCGGCGACCGC
```

2153 EPOETIN ALFA

```
GCCCCCCCCCGCCTGATCTGCGACTCCCGCGTGCTGGAGCGCTACCTGCTGGAGGCCAAGGAGGCCGAGAACATCACCA
CCGGCTGCGCCGAGCACTGCTCCCTGAACGAGAACATCACCGTGCCCGACACCAAGGTGAACTTCTACGCCTGGAAGCG
CATGGAGGTGGGCCAGCAGGCCGTGGAGGTGTGGCAGGGCCTGGCCCTGCTGTCCGAGGCCGTGCTGCGCGGCCAGGCC
CTGCTGGTGAACTCCTCCCAGCCCTGGGAGCCCCTGCAGCTGCACGTGGACAAGGCCGTGTCCGGCCTGCGCTCCCTGA
CCACCCTGCTGCGCGCCCTGGGCGCCCAGAAGGAGGCCATCTCCCCCCCCGACGCCGCCTCCGCCGCCCCCTGCGCAC
CATCACCGCCGACACCTTCCGCAAGCTGTTCCGCGTGTACTCCAACTTCCTGCGCGGCAAGCTGAAGCTGTACACCGGC
GAGGCCTGCCGCACCGGCGACCGC
```

Figure 34

| Figure 34a |
| Figure 34b |
| Figure 34d |
| Figure 34e |
| Figure 34f |

Figure 34a

```
          - - - - - - M A L S F S L L M A L L V L  Majority
                              10                  20

1  - - - - - - M A S P F A L L M V L V V L  h IFN Alpha 1.pro    SEQ ID NO.: 1406
1  - - - - - - M A L T F A L L V A L L V L  h IFN Alpha 2a .pro  SEQ ID NO.: 1422
1  - - - - - - M A L T F A L L V A L L V L  h IFN Alpha 2b .pro  SEQ ID NO.: 1438
1  - - - - - - M A L S F S L L M A V L V L  h IFN Alpha 4a.pro   SEQ ID NO.: 1454
1  - - - - - - M A L S F S L L M A V L V L  h IFN Alpha 4b.pro   SEQ ID NO.: 1470
1  - - - - - - M A L P F V L L M A L V V L  h IFN Alpha 5.pro    SEQ ID NO.: 1486
1  - - - - - - M A L P F A L L M A L V V L  h IFN Alpha 6.pro    SEQ ID NO.: 1502
1  - - - - - - M A R S F S L L M V V L V L  h IFN Alpha 7.pro    SEQ ID NO.: 1518
1  - - - - - - M A L T F Y L L V A L V V L  h IFN Alpha 8.pro    SEQ ID NO.: 1534
1  - - - - - - M A L S F S L L M A V L V L  h IFN Alpha 10.pro   SEQ ID NO.: 1550
1  - - - - - - M A S P F A L L M A L V V L  h IFN Alpha 13.pro   SEQ ID NO.: 1566
1  - - - - - - M A L P F A L M M A L V V L  h IFN alpha 14 .pro  SEQ ID NO.: 1582
1  - - - - - - M A L S F S L L M A V L V L  h IFN Alpha 16.pro   SEQ ID NO.: 1598
1  - - - - - - M A L S F S L L M A V L V L  h IFN Alpha 17.pro   SEQ ID NO.: 1614
1  - - - - - - M A L S F S L L M A V L V L  h IFN Alpha 21.pro   SEQ ID NO.: 1630
1  - - - - - - M A L P F A L M M A L V V L  h IFN Alpha H.pro    SEQ ID NO.: 1646
1  - - - - - - M A L S F S L L M A V L V L  h IFN Alpha I.pro    SEQ ID NO.: 1662
1  - - - - - - M A R S F S L L M A V L V L  h IFN Alpha J1.pro   SEQ ID NO.: 1678
1  - - - - - - M T N K C L Q I A L L L C    h IFN beta 1 .pro    SEQ ID NO.: 1694
1  M S T K P D M I Q K C L W L E I L M G I  h IFN Kappa.pro      SEQ ID NO.: 1710
1  - - - - - - M A L L F P L L A A L V M T  h IFN Omega 1 .pro   SEQ ID NO.: 1726
1  - - - - - - M I I K H F F G T V L V L L  h IFN Tau .pro       SEQ ID NO.: 1742
1  - - - - - - M A L P F A L M M A L V V L  Infergen w A14 Sig   SEQ ID NO.: 1758

S Y K S I C S L G C D L P Q T H S L G -  Majority
                       30                40

15  S C K S S C S L G C D L P E T H S L D -  h IFN Alpha 1.pro    SEQ ID NO.: 1406
15  S C K S S C S V G C D L P Q T H S L G -  h IFN Alpha 2a .pro  SEQ ID NO.: 1422
15  S C K S S C S V G C D L P Q T H S L G -  h IFN Alpha 2b .pro  SEQ ID NO.: 1438
15  S Y K S I C S L G C D L P Q T H S L G -  h IFN Alpha 4a.pro   SEQ ID NO.: 1454
15  S Y K S I C S L G C D L P Q T H S L G -  h IFN Alpha 4b.pro   SEQ ID NO.: 1470
15  N C K S I C S L G C D L P Q T H S L S -  h IFN Alpha 5.pro    SEQ ID NO.: 1486
15  S C K S S C S L D C D L P Q T H S L G -  h IFN Alpha 6.pro    SEQ ID NO.: 1502
15  S Y K S I C S L G C D L P Q T H S L R -  h IFN Alpha 7.pro    SEQ ID NO.: 1518
15  S Y K S F S S L G C D L P Q T H S L G -  h IFN Alpha 8.pro    SEQ ID NO.: 1534
15  S Y K S I C S L G C D L P Q T H S L G -  h IFN Alpha 10.pro   SEQ ID NO.: 1550
15  S C K S S C S L G C D L P E T H S L D -  h IFN Alpha 13.pro   SEQ ID NO.: 1566
15  S C K S S C S L G C N L S Q T H S L N -  h IFN alpha 14 .pro  SEQ ID NO.: 1582
15  S Y K S I C S L G C D L P Q T H S L G -  h IFN Alpha 16.pro   SEQ ID NO.: 1598
15  S Y K S I C S L G C D L P Q T H S L G -  h IFN Alpha 17.pro   SEQ ID NO.: 1614
15  S Y K S I C S L G C D L P Q T H S L G -  h IFN Alpha 21.pro   SEQ ID NO.: 1630
15  S C K S S C S L G C N L S Q T H S L N -  h IFN Alpha H.pro    SEQ ID NO.: 1646
15  S Y K S I C S L G C D L P Q T H S L G -  h IFN Alpha I.pro    SEQ ID NO.: 1662
15  S Y K S I C S L G C D L P Q T H S L R -  h IFN Alpha J1.pro   SEQ ID NO.: 1678
15  F S T T A L S M S Y N L L G F L Q R S S  h IFN beta 1 .pro    SEQ ID NO.: 1694
21  F I A G T L S L D C N L L N V H L R R V  h IFN Kappa.pro      SEQ ID NO.: 1710
15  S Y S P V G S L G C D L P Q N H G L L -  h IFN Omega 1 .pro   SEQ ID NO.: 1726
15  A S T T I F S L D L K L I I F Q Q R Q V  h IFN Tau .pro       SEQ ID NO.: 1742
15  S C K S S C S L G C D L P Q T H S L G -  Infergen w A14 Sig   SEQ ID NO.: 1758
```

Figure 34b

```
    N R R A L I L L A Q M G R I S P F S C L  Majority
                    50                  60
34  N R R T L M L L A Q M S R I S P S S C L  h IFN Alpha 1.pro      SEQ ID NO.: 1406
34  S R R T L M L L A Q M R K I S L F S C L  h IFN Alpha 2a .pro    SEQ ID NO.: 1422
34  S R R T L M L L A Q M R R I S L F S C L  h IFN Alpha 2b .pro    SEQ ID NO.: 1438
34  N R R A L I L L A Q M G R I S H F S C L  h IFN Alpha 4a.pro     SEQ ID NO.: 1454
34  N R R A L I L L A Q M G R I S H F S C L  h IFN Alpha 4b.pro     SEQ ID NO.: 1470
34  N R R T L M I M A Q M G R I S P F S C L  h IFN Alpha 5.pro      SEQ ID NO.: 1486
34  H R R T M M L L A Q M R R I S L F S C L  h IFN Alpha 6.pro      SEQ ID NO.: 1502
34  N R R A L I L L A Q M G R I S P F S C L  h IFN Alpha 7.pro      SEQ ID NO.: 1518
34  N R R A L I L L A Q M R R I S P F S C L  h IFN Alpha 8.pro      SEQ ID NO.: 1534
34  N R R A L I L L G Q M G R I S P F S C L  h IFN Alpha 10.pro     SEQ ID NO.: 1550
34  N R R T L M L L A Q M S R I S P S S C L  h IFN Alpha 13.pro     SEQ ID NO.: 1566
34  N R R T L M L M A Q M R R I S P F S C L  h IFN alpha 14 .pro    SEQ ID NO.: 1582
34  N R R A L I L L A Q M G R I S H F S C L  h IFN Alpha 16.pro     SEQ ID NO.: 1598
34  N R R A L I L L A Q M G R I S P F S C L  h IFN Alpha 17.pro     SEQ ID NO.: 1614
34  N R R A L I L L A Q M G R I S P F S C L  h IFN Alpha 21.pro     SEQ ID NO.: 1630
34  N R R T L M L M A Q M R R I S P F S C L  h IFN Alpha H.pro      SEQ ID NO.: 1646
34  N R R A L I L L A Q M G R I S P F S C L  h IFN Alpha I.pro      SEQ ID NO.: 1662
34  N R R A L I L L A Q M G R I S P F S C L  h IFN Alpha J1.pro     SEQ ID NO.: 1678
35  N F Q C Q K L L W Q L N G R L - E Y C L  h IFN beta 1 .pro      SEQ ID NO.: 1694
41  T W Q N L R H L S S M S N S F P V E C L  h IFN Kappa.pro        SEQ ID NO.: 1710
34  S R N T L V L L H Q M R R I S P F L C L  h IFN Omega 1 .pro     SEQ ID NO.: 1726
35  N Q E S L K L L N K L Q T L S I Q Q C L  h IFN Tau .pro         SEQ ID NO.: 1742
34  N R R A L I L L A Q M R R I S P F S C L  Infergen w A14 Sig     SEQ ID NO.: 1758

K D R H D F G F P Q E E F D G N Q F Q K  Majority
                    70                  80
54  M D R H D F G F P Q E E F D G N Q F Q K  h IFN Alpha 1.pro      SEQ ID NO.: 1406
54  K D R H D F G F P Q E E F - G N Q F Q K  h IFN Alpha 2a .pro    SEQ ID NO.: 1422
54  K D R H D F G F P Q E E F - G N Q F Q K  h IFN Alpha 2b .pro    SEQ ID NO.: 1438
54  K D R H D F G F P E E E F D G H Q F Q K  h IFN Alpha 4a.pro     SEQ ID NO.: 1454
54  K D R H D F G F P E E E F D G H Q F Q K  h IFN Alpha 4b.pro     SEQ ID NO.: 1470
54  K D R H D F G F P Q E E F D G N Q F Q K  h IFN Alpha 5.pro      SEQ ID NO.: 1486
54  K D R H D F R F P Q E E F D G N Q F Q K  h IFN Alpha 6.pro      SEQ ID NO.: 1502
54  K D R H E F R F P E E E F D G H Q F Q K  h IFN Alpha 7.pro      SEQ ID NO.: 1518
54  K D R H D F E F P Q E E F D D K Q F Q K  h IFN Alpha 8.pro      SEQ ID NO.: 1534
54  K D R H D F R I P Q E E F D G N Q F Q K  h IFN Alpha 10.pro     SEQ ID NO.: 1550
54  M D R H D F G F P Q E E F D G N Q F Q K  h IFN Alpha 13.pro     SEQ ID NO.: 1566
54  K D R H D F E F P Q E E F D G N Q F Q K  h IFN alpha 14 .pro    SEQ ID NO.: 1582
54  K D R Y D F G F P Q E V F D G N Q F Q K  h IFN Alpha 16.pro     SEQ ID NO.: 1598
54  K D R H D F G L P Q E E F D G N Q F Q K  h IFN Alpha 17.pro     SEQ ID NO.: 1614
54  K D R H D F G F P Q E E F D G N Q F Q K  h IFN Alpha 21.pro     SEQ ID NO.: 1630
54  K D R H D F E F P Q E E F D G N Q F Q K  h IFN Alpha H.pro      SEQ ID NO.: 1646
54  K D R P D F G L P Q E E F D G N Q F Q K  h IFN Alpha I.pro      SEQ ID NO.: 1662
54  K D R H E F R F P E E E F D G H Q F Q K  h IFN Alpha J1.pro     SEQ ID NO.: 1678
54  K D R M N F D I P E E I K Q L Q Q F Q K  h IFN beta 1 .pro      SEQ ID NO.: 1694
61  R E N I A F E L P Q E F L Q Y T Q P M K  h IFN Kappa.pro        SEQ ID NO.: 1710
54  K D R R D F R F P Q E M V K G S Q L Q K  h IFN Omega 1 .pro     SEQ ID NO.: 1726
55  P H R K N F L L P Q K S L S P Q Q Y Q K  h IFN Tau .pro         SEQ ID NO.: 1742
54  K D R H D F G F P Q E E F D G N Q F Q K  Infergen w A14 Sig     SEQ ID NO.: 1758
```

Figure 34c

```
       A Q A I S V L H E M I Q Q T F N L F S T  Majority
                           |                 |
                          90                100
 74   A P A I S V L H E L I Q Q I F N L F T T  h IFN Alpha 1.pro    SEQ ID NO.: 1406
 73   A E T I P V L H E M I Q Q I F N L F S T  h IFN Alpha 2a .pro  SEQ ID NO.: 1422
 73   A E T I P V L H E M I Q Q I F N L F S T  h IFN Alpha 2b .pro  SEQ ID NO.: 1438
 74   A Q A I S V L H E M I Q Q T F N L F S T  h IFN Alpha 4a.pro   SEQ ID NO.: 1454
 74   T Q A I S V L H E M I Q Q T F N L F S T  h IFN Alpha 4b.pro   SEQ ID NO.: 1470
 74   A Q A I S V L H E M I Q Q T F N L F S T  h IFN Alpha 5.pro    SEQ ID NO.: 1486
 74   A E A I S V L H E V I Q Q T F N L F S T  h IFN Alpha 6.pro    SEQ ID NO.: 1502
 74   T Q A I S V L H E M I Q Q T F N L F S T  h IFN Alpha 7.pro    SEQ ID NO.: 1518
 74   A Q A I S V L H E M I Q Q T F N L F S T  h IFN Alpha 8.pro    SEQ ID NO.: 1534
 74   A Q A I S V L H E M I Q Q T F N L F S T  h IFN Alpha 10.pro   SEQ ID NO.: 1550
 74   A P A I S V L H E L I Q Q I F N L F T T  h IFN Alpha 13.pro   SEQ ID NO.: 1566
 74   A Q A I S V L H E M M Q Q T F N L F S T  h IFN alpha 14 .pro  SEQ ID NO.: 1582
 74   A Q A I S A F H E M I Q Q T F N L F S T  h IFN Alpha 16.pro   SEQ ID NO.: 1598
 74   T Q A I S V L H E M I Q Q T F N L F S T  h IFN Alpha 17.pro   SEQ ID NO.: 1614
 74   A Q A I S V L H E M I Q Q T F N L F S T  h IFN Alpha 21.pro   SEQ ID NO.: 1630
 74   A Q A I S V L H E M M Q Q T F N L F S T  h IFN Alpha H.pro    SEQ ID NO.: 1646
 74   T Q A I S V L H E M I Q Q T F N L F S T  h IFN Alpha I.pro    SEQ ID NO.: 1662
 74   T Q A I S V L H E M I Q Q T F N L F S T  h IFN Alpha J1.pro   SEQ ID NO.: 1678
 74   E D A A L T I Y E M L Q N I F A I F R Q  h IFN beta 1 .pro    SEQ ID NO.: 1694
 81   R D I K K A F Y E M S L Q A F N I F S Q  h IFN Kappa.pro      SEQ ID NO.: 1710
 74   A H V M S V L H E M L Q Q I F S L F H T  h IFN Omega 1 .pro   SEQ ID NO.: 1726
 75   G H T L A I L H E M L Q Q I F S L F R A  h IFN Tau .pro       SEQ ID NO.: 1742
 74   A Q A I S V L H E M I Q Q T F N L F S T  Infergen w A14 Sig   SEQ ID NO.: 1758

K D S S A A W D E S L L E K F Y T E L Y  Majority
                           |                 |
                          110               120
 94   K D S S A A W D E D L L D K F C T E L Y  h IFN Alpha 1.pro    SEQ ID NO.: 1406
 93   K D S S A A W D E T L L D K F Y T E L Y  h IFN Alpha 2a .pro  SEQ ID NO.: 1422
 93   K D S S A A W D E T L L D K F Y T E L Y  h IFN Alpha 2b .pro  SEQ ID NO.: 1438
 94   E D S S A A W E Q S L L E K F S T E L Y  h IFN Alpha 4a.pro   SEQ ID NO.: 1454
 94   E D S S A A W E Q S L L E K F S T E L Y  h IFN Alpha 4b.pro   SEQ ID NO.: 1470
 94   K D S S A T W D E T L L D K F Y T E L Y  h IFN Alpha 5.pro    SEQ ID NO.: 1486
 94   K D S S V A W D E R L L D K L Y T E L Y  h IFN Alpha 6.pro    SEQ ID NO.: 1502
 94   E D S S A A W E Q S L L E K F S T E L Y  h IFN Alpha 7.pro    SEQ ID NO.: 1518
 94   K D S S A A L D E T L L D E F Y I E L D  h IFN Alpha 8.pro    SEQ ID NO.: 1534
 94   E D S S A A W E Q S L L E K F S T E L Y  h IFN Alpha 10.pro   SEQ ID NO.: 1550
 94   K D S S A A W D E D L L D K F C T E L Y  h IFN Alpha 13.pro   SEQ ID NO.: 1566
 94   K N S S A A W D E T L L E K F Y I E L F  h IFN alpha 14 .pro  SEQ ID NO.: 1582
 94   K D S S A A W D E T L L D K F Y I E L F  h IFN Alpha 16.pro   SEQ ID NO.: 1598
 94   E D S S A A W E Q S L L E K F S T E L Y  h IFN Alpha 17.pro   SEQ ID NO.: 1614
 94   K D S S A T W E Q S L L E K F S T E L N  h IFN Alpha 21.pro   SEQ ID NO.: 1630
 94   K N S S A A W D E T L L E K F Y I E L F  h IFN Alpha H.pro    SEQ ID NO.: 1646
 94   E D S S A A W E Q S L L E K F S T E L Y  h IFN Alpha I.pro    SEQ ID NO.: 1662
 94   E D S S A A W E Q S L L E K F S T E L Y  h IFN Alpha J1.pro   SEQ ID NO.: 1678
 94   D S S S T G W N E T I V E N L L A N V Y  h IFN beta 1 .pro    SEQ ID NO.: 1694
101   H T F K Y - W K E R H L K Q I Q I G L D  h IFN Kappa.pro      SEQ ID NO.: 1710
 94   E R S S A A W N M T L L D Q L H T G L H  h IFN Omega 1 .pro   SEQ ID NO.: 1726
 95   N I S L D G W E E N H T E K F L I Q L H  h IFN Tau .pro       SEQ ID NO.: 1742
 94   K D S S A A W D E S L L E K F Y T E L Y  Infergen w A14 Sig   SEQ ID NO.: 1758
```

Figure 34d

```
        Q Q L N D L E A C V I Q E - V G V E E T  Majority
                        130              140
114  Q Q L N D L E A C V M Q E - E R V G E T   h IFN Alpha 1.pro    SEQ ID NO.: 1406
113  Q Q L N D L E A C V I Q G - V G V T E T   h IFN Alpha 2a .pro  SEQ ID NO.: 1422
113  Q Q L N D L E A C V I Q G - V G V T E T   h IFN Alpha 2b .pro  SEQ ID NO.: 1438
114  Q Q L N D L E A C V I Q E - V G V E E T   h IFN Alpha 4a.pro   SEQ ID NO.: 1454
114  Q Q L N D L E A C V I Q E - V G V E E T   h IFN Alpha 4b.pro   SEQ ID NO.: 1470
114  Q Q L N D L E A C M M Q E - V G V E D T   h IFN Alpha 5.pro    SEQ ID NO.: 1486
114  Q Q L N D L E A C V M Q E - V W V G G T   h IFN Alpha 6.pro    SEQ ID NO.: 1502
114  Q Q L N D L E A C V I Q E - V G V E E T   h IFN Alpha 7.pro    SEQ ID NO.: 1518
114  Q Q L N D L E S C V M Q E - V G V I E S   h IFN Alpha 8.pro    SEQ ID NO.: 1534
114  Q Q L N D L E A C V I Q E - V G V E E T   h IFN Alpha 10.pro   SEQ ID NO.: 1550
114  Q Q L N D L E A C V M Q E - E R V G E T   h IFN Alpha 13.pro   SEQ ID NO.: 1566
114  Q Q M N D L E A C V I Q E - V G V E E T   h IFN alpha 14 .pro  SEQ ID NO.: 1582
114  Q Q L N D L E A C V T Q E - V G V E E I   h IFN Alpha 16.pro   SEQ ID NO.: 1598
114  Q Q L N N L E A C V I Q E - V G M E E T   h IFN Alpha 17.pro   SEQ ID NO.: 1614
114  Q Q L N D L E A C V I Q E - V G V E E T   h IFN Alpha 21.pro   SEQ ID NO.: 1630
114  Q Q M N D L E A C V I Q E - V G V E E T   h IFN Alpha H.pro    SEQ ID NO.: 1646
114  Q Q L N N L E A C V I Q E - V G M E E T   h IFN Alpha I.pro    SEQ ID NO.: 1662
114  Q Q L N D L E A C V I Q E - V G V E E T   h IFN Alpha J1.pro   SEQ ID NO.: 1678
114  H Q I N H L K T V L E E K - L E K E D F   h IFN beta 1 .pro    SEQ ID NO.: 1694
120  Q Q A E Y L N Q C L E E D E N E N E D M   h IFN Kappa.pro      SEQ ID NO.: 1710
114  Q Q L Q H L E T C L L Q V - V G E G E S   h IFN Omega 1 .pro   SEQ ID NO.: 1726
115  Q Q L E Y L E A L M G - - - L E A E K L   h IFN Tau .pro       SEQ ID NO.: 1742
114  Q Q L N D L E A C V I Q E - V G V E E T   Infergen w A14 Sig   SEQ ID NO.: 1758

P L M N E D - - - - - - - - - - - S I  Majority
                        150              160
133  P L M N A D - - - - - - - - - - - S I   h IFN Alpha 1.pro    SEQ ID NO.: 1406
132  P L M K E D - - - - - - - - - - - S I   h IFN Alpha 2a .pro  SEQ ID NO.: 1422
132  P L M K E D - - - - - - - - - - - S I   h IFN Alpha 2b .pro  SEQ ID NO.: 1438
133  P L M N E D - - - - - - - - - - - S I   h IFN Alpha 4a.pro   SEQ ID NO.: 1454
133  P L M N V D - - - - - - - - - - - S I   h IFN Alpha 4b.pro   SEQ ID NO.: 1470
133  P L M N V D - - - - - - - - - - - S I   h IFN Alpha 5.pro    SEQ ID NO.: 1486
133  P L M N E D - - - - - - - - - - - S I   h IFN Alpha 6.pro    SEQ ID NO.: 1502
133  P L M N E D - - - - - - - - - - - F I   h IFN Alpha 7.pro    SEQ ID NO.: 1518
133  P L M Y E D - - - - - - - - - - - S I   h IFN Alpha 8.pro    SEQ ID NO.: 1534
133  P L M N E D - - - - - - - - - - - S I   h IFN Alpha 10.pro   SEQ ID NO.: 1550
133  P L M N A D - - - - - - - - - - - S I   h IFN Alpha 13.pro   SEQ ID NO.: 1566
133  P L M N E D - - - - - - - - - - - S I   h IFN alpha 14 .pro  SEQ ID NO.: 1582
133  A L M N E D - - - - - - - - - - - S I   h IFN Alpha 16.pro   SEQ ID NO.: 1598
133  P L M N E D - - - - - - - - - - - S I   h IFN Alpha 17.pro   SEQ ID NO.: 1614
133  P L M N V D - - - - - - - - - - - S I   h IFN Alpha 21.pro   SEQ ID NO.: 1630
133  P L M N E D - - - - - - - - - - - S I   h IFN Alpha H.pro    SEQ ID NO.: 1646
133  P L M N E D - - - - - - - - - - - S I   h IFN Alpha I.pro    SEQ ID NO.: 1662
133  P L M N E D - - - - - - - - - - - F I   h IFN Alpha J1.pro   SEQ ID NO.: 1678
133  T R G K - - - - - - - - - - - L M S S   h IFN beta 1 .pro    SEQ ID NO.: 1694
140  K E M K E N E M K P S E A R V P Q L S S   h IFN Kappa.pro      SEQ ID NO.: 1710
133  A G A I S S - - - - - - - - - - - P A   h IFN Omega 1 .pro   SEQ ID NO.: 1726
132  S G T L G S - - - - - - - - - - - D N L R h IFN Tau .pro     SEQ ID NO.: 1742
133  P L M N V D - - - - - - - - - - - S I   Infergen w A14 Sig   SEQ ID NO.: 1758
```

Figure 34e

```
        L A V R K Y F Q R I T L Y L T E K K Y S  Majority
                      170              180
141  L A V K K Y F R R I T L Y L T E K K Y S   h IFN Alpha 1.pro      SEQ ID NO.: 1406
140  L A V R K Y F Q R I T L Y L K E K K Y S   h IFN Alpha 2a .pro    SEQ ID NO.: 1422
140  L A V R K Y F Q R I T L Y L K E K K Y S   h IFN Alpha 2b .pro    SEQ ID NO.: 1438
141  L A V R K Y F Q R I T L Y L T E K K Y S   h IFN Alpha 4a.pro     SEQ ID NO.: 1454
141  L A V R K Y F Q R I T L Y L T E K K Y S   h IFN Alpha 4b.pro     SEQ ID NO.: 1470
141  L T V R K Y F Q R I T L Y L T E K K Y S   h IFN Alpha 5.pro      SEQ ID NO.: 1486
141  L A V R K Y F Q R I T L Y L T E K K Y S   h IFN Alpha 6.pro      SEQ ID NO.: 1502
141  L A V R K Y F Q R I T L Y L M E K K Y S   h IFN Alpha 7.pro      SEQ ID NO.: 1518
141  L A V R K Y F Q R I T L Y L T E K K Y S   h IFN Alpha 8.pro      SEQ ID NO.: 1534
141  L A V R K Y F Q R I T L Y L I E R K Y S   h IFN Alpha 10.pro     SEQ ID NO.: 1550
141  L A V K K Y F R R I T L Y L T E K K Y S   h IFN Alpha 13.pro     SEQ ID NO.: 1566
141  L A V K K Y F Q R I T L Y L M E K K Y S   h IFN alpha 14 .pro    SEQ ID NO.: 1582
141  L A V R K Y F Q R I T L Y L M G K K Y S   h IFN Alpha 16.pro     SEQ ID NO.: 1598
141  L A V R K Y F Q R I T L Y L T E K K Y S   h IFN Alpha 17.pro     SEQ ID NO.: 1614
141  L A V K K Y F Q R I T L Y L T E K K Y S   h IFN Alpha 21.pro     SEQ ID NO.: 1630
141  L A V K K Y F Q R I T L Y L M E K K Y S   h IFN Alpha H.pro      SEQ ID NO.: 1646
141  L A V R K Y F Q R I T L Y L T E K K Y S   h IFN Alpha I.pro      SEQ ID NO.: 1662
141  L A V R K Y F Q R I T L Y L T E K K Y S   h IFN Alpha J1.pro     SEQ ID NO.: 1678
141  L H L K R Y G R I L H Y L K A K E Y S     h IFN beta 1 .pro      SEQ ID NO.: 1694
160  L E L R R Y F H R I D N F L K E K K Y S   h IFN Kappa.pro        SEQ ID NO.: 1710
141  L T L R R Y F Q G I R V Y L K E K K Y S   h IFN Omega 1 .pro     SEQ ID NO.: 1726
142  L Q V K M Y F R R I H D Y L E N Q D Y S   h IFN Tau .pro         SEQ ID NO.: 1742
141  L A V K K Y F Q R I T L Y L T E K K Y S   Infergen w A14 Sig     SEQ ID NO.: 1758

P C A W E V V R A E I M R S F S F S T N  Majority
                      190              200
161  P C A W E V V R A E I M R S L S L S T N   h IFN Alpha 1.pro      SEQ ID NO.: 1406
160  P C A W E V V R A E I M R S F S L S T N   h IFN Alpha 2a .pro    SEQ ID NO.: 1422
160  P C A W E V V R A E I M R S F S L S T N   h IFN Alpha 2b .pro    SEQ ID NO.: 1438
161  P C A W E V V R A E I M R S L S F S T N   h IFN Alpha 4a.pro     SEQ ID NO.: 1454
161  P C A W E V V R A E I M R S L S F S T N   h IFN Alpha 4b.pro     SEQ ID NO.: 1470
161  P C A W E V V R A E I M R S F S L S A N   h IFN Alpha 5.pro      SEQ ID NO.: 1486
161  P C A W E V V R A E I M R S F S S S R N   h IFN Alpha 6.pro      SEQ ID NO.: 1502
161  P C A W E V V R A E I M R S F S F S T N   h IFN Alpha 7.pro      SEQ ID NO.: 1518
161  S C A W E V V R A E I M R S F S L S I N   h IFN Alpha 8.pro      SEQ ID NO.: 1534
161  P C A W E V V R A E I M R S L S F S T N   h IFN Alpha 10.pro     SEQ ID NO.: 1550
161  P C A W E V V R A E I M R S L S L S T N   h IFN Alpha 13.pro     SEQ ID NO.: 1566
161  P C A W E V V R A E I M R S F S F S T N   h IFN alpha 14 .pro    SEQ ID NO.: 1582
161  P C A W E V V R A E I M R S F S F S T N   h IFN Alpha 16.pro     SEQ ID NO.: 1598
161  P C A W E V V R A E I M R S L S F S T N   h IFN Alpha 17.pro     SEQ ID NO.: 1614
161  P C A W E V V R A E I M R S L S K I       h IFN Alpha 21.pro     SEQ ID NO.: 1630
161  P C A W E V V R A E I M R S L S F S T N   h IFN Alpha H.pro      SEQ ID NO.: 1646
161  P C A W E V V R A E I M R S L S F S T N   h IFN Alpha I.pro      SEQ ID NO.: 1662
161  P C A W E V V R A E I M R S F S F S T N   h IFN Alpha J1.pro     SEQ ID NO.: 1678
161  H C A W T I V R V E I L R N F Y F I N R   h IFN beta 1 .pro      SEQ ID NO.: 1694
180  D C A W E I V R V E I R R C L Y Y F Y K   h IFN Kappa.pro        SEQ ID NO.: 1710
161  D C A W E V V R M E I M K S L F L S T N   h IFN Omega 1 .pro     SEQ ID NO.: 1726
162  T C A W A I V Q V E I S R C L F F V F S   h IFN Tau .pro         SEQ ID NO.: 1742
161  P C A W E V V R A E I M R S F S L S T N   Infergen w A14 Sig     SEQ ID NO.: 1758
```

Figure 34f

```
        L Q K R L R R K D - - - - - - - - - - -    Majority
                        |                    |
                       210                  220
```

| # | Sequence | Name | SEQ ID NO. |
|---|---|---|---|
| 181 | L Q E R L R R K E | h IFN Alpha 1.pro | 1406 |
| 180 | L Q E S L R S K E | h IFN Alpha 2a .pro | 1422 |
| 180 | L Q E S L R S K E | h IFN Alpha 2b .pro | 1438 |
| 181 | L Q K R L R R K D | h IFN Alpha 4a.pro | 1454 |
| 181 | L Q K R L R R K D | h IFN Alpha 4b.pro | 1470 |
| 181 | L Q E R L R R K E | h IFN Alpha 5.pro | 1486 |
| 181 | L Q E R L R R K E | h IFN Alpha 6.pro | 1502 |
| 181 | L K K G L R R K D | h IFN Alpha 7.pro | 1518 |
| 181 | L Q K R L K S K E | h IFN Alpha 8.pro | 1534 |
| 181 | L Q K R L R R K D | h IFN Alpha 10.pro | 1550 |
| 181 | L Q E R L R R K E | h IFN Alpha 13.pro | 1566 |
| 181 | L Q K R L R R K D | h IFN alpha 14 .pro | 1582 |
| 181 | L Q K G L R R K D | h IFN Alpha 16.pro | 1598 |
| 181 | L Q K I L R R K D | h IFN Alpha 17.pro | 1614 |
| 181 | F Q E R L R R K E | h IFN Alpha 21.pro | 1630 |
| 181 | L Q K R L R R K D | h IFN Alpha H.pro | 1646 |
| 181 | L Q K I L R R K D | h IFN Alpha I.pro | 1662 |
| 181 | L K K G L R R K D | h IFN Alpha J1.pro | 1678 |
| 181 | L T G Y L R N | h IFN beta 1 .pro | 1694 |
| 200 | F T A L F R R K | h IFN Kappa.pro | 1710 |
| 181 | M Q E R L R S K D R D L G S S | h IFN Omega 1 .pro | 1726 |
| 182 | L T E K L S K Q G R P L N D M K Q E L T | h IFN Tau .pro | 1742 |
| 181 | L Q E R L R R K E | Infergen w A14 Sig | 1758 |

```
        - - - - - - -     Majority
```

| # | Sequence | Name | SEQ ID NO. |
|---|---|---|---|
| 189 | | h IFN Alpha 1.pro | 1406 |
| 188 | | h IFN Alpha 2a .pro | 1422 |
| 188 | | h IFN Alpha 2b .pro | 1438 |
| 189 | | h IFN Alpha 4a.pro | 1454 |
| 189 | | h IFN Alpha 4b.pro | 1470 |
| 189 | | h IFN Alpha 5.pro | 1486 |
| 189 | | h IFN Alpha 6.pro | 1502 |
| 189 | | h IFN Alpha 7.pro | 1518 |
| 189 | | h IFN Alpha 8.pro | 1534 |
| 189 | | h IFN Alpha 10.pro | 1550 |
| 189 | | h IFN Alpha 13.pro | 1566 |
| 189 | | h IFN alpha 14 .pro | 1582 |
| 189 | | h IFN Alpha 16.pro | 1598 |
| 189 | | h IFN Alpha 17.pro | 1614 |
| 189 | | h IFN Alpha 21.pro | 1630 |
| 189 | | h IFN Alpha H.pro | 1646 |
| 189 | | h IFN Alpha I.pro | 1662 |
| 189 | | h IFN Alpha J1.pro | 1678 |
| 187 | | h IFN beta 1 .pro | 1694 |
| 207 | | h IFN Kappa.pro | 1710 |
| 195 | | h IFN Omega 1 .pro | 1726 |
| 202 | T E F R S P R | h IFN Tau .pro | 1742 |
| 189 | | Infergen w A14 Sig | 1758 |

HYPERGLYCOSYLATED POLYPEPTIDE VARIANTS AND METHODS OF USE

CROSS-REFERENCE

This application is a continuation-in-part of U.S. patent application Ser. No. 11/330,917, filed Jan. 11, 2006, which is a continuation of U.S. patent application Ser. No. 11/200,531, filed Aug. 8, 2005; and also claims the benefit of U.S. Provisional Patent Application Nos. 60/600,202, filed Aug. 9, 2004, 60/600,134, filed Aug. 9, 2004, 60/604,280, filed Aug. 24, 2004, and 60/604,415, filed Aug. 24, 2004, each of which applications are incorporated herein by reference in their entirety.

FIELD OF THE INVENTION

The present invention is in the field of glycosylated, and glycosylated protease-resistant protein therapeutics.

SEQUENCE LISTING

The present specification incorporates herein by reference, each in its entirety, the sequence information on the Compact Disks (CDs) labeled Copy 1 and Copy 2. The CDs are formatted on IBM-PC, with operating system compatibility with MS-Windows. The files on each of the CDs are as follows:
Copy 1—Seqlist.txt 1931 KB created May 3, 2006; and
Copy 2—Seqlist.txt 1931 KB created May 3, 2006.

BACKGROUND OF THE INVENTION

The use of proteins as therapeutic agents has gained in clinical importance. Nevertheless, there remain various obstacles and drawbacks to their use, including immunogenicity; destruction of the therapeutic protein by enzymes produced by the host; suboptimal pharmacokinetic properties; and the like. For example, immunogenicity of a therapeutic protein can lead to neutralization of the protein's activity by neutralizing antibodies generated over time in the subject being treated. In addition, immunogenicity of a therapeutic protein can lead to an inflammatory response. Destruction of a therapeutic protein by host enzymes may preclude the use of certain routes of administration. For example, oral administration of therapeutic proteins may be desirable in treating certain conditions; however, the therapeutic protein may be destroyed by enzymes in the gastrointestinal tract of the individual being treated. Furthermore, a therapeutic protein may have a short serum half life, due, e.g., to rapid elimination of the protein by the host reticuloendothelial system; as a consequence, the pharmacokinetic profile of the therapeutic protein may be such that repeated, frequent administration is necessary.

Many proteins with therapeutic potential include one or more glycosylation sites, e.g., amino acid sequences that are glycosylated by a eukaryotic cell. There have been various reports of attempts to increase the degree of glycosylation of therapeutic proteins in order to achieve 1) reduced immunogenicity; 2) less frequent administration of the protein; 3) increased serum half-life; and 4) reduction in adverse side effects such as inflammation.

Destruction of a therapeutic protein by host enzymes may preclude the use of certain routes of administration. For example, oral administration of therapeutic proteins may be desirable in treating certain conditions; however, the therapeutic protein may be destroyed by proteolytic enzymes in the gastrointestinal tract and/or in the serum of the individual being treated. Such proteolytic enzymes include, e.g., α-chymotrypsin, carboxypeptidase, endoproteinase Arg-C, endoproteinase Asp-N, endoproteinase Glu-C, endoproteinase Lys-C, and trypsin.

There is a need in the art for therapeutic proteins in oral dosage forms having suitable pharmacokinetic properties. The present invention addresses this need.

Literature

U.S. Pat. No. 6,685,933; U.S. Pat. Nos. 4,695,623 and 4,897,471; U.S. Pat. No. 6,703,225; U.S. Pat. No. 6,569,420; U.S. Pat. No. 6,299,877; U.S. Pat. No. 6,586,398; U.S. Pat. No. 6,531,122; U.S. Pat. No. 6,646,110; Egrie and Brown, Br J Cancer. 2001 April; 84 Suppl 1:3-10; U.S. Pat. No. 6,127,332; WO 00/26354; WO 02/081507; WO 01/36001; U.S. Pat. No. 5,041,376; U.S. Pat. No. 5,520,911; U.S. Pat. No. 6,673,580; U.S. Pat. No. 5,853,724; U.S. Pat. No. 6,132,970; European Patent Application No. 640,619; WO 04/022747; and WO 004/0222593. Nyman et al. (11028) *Eur. J. Biochem.* 253:485-493; Runkel et al. (11028) *Pharmaceutical Research* 15:641; Adolf et al. (11020) *J. Biol. Chem.* 265: 9290-9295.

SEQUENCE LISTING

The present specification incorporates herein by reference, each in its entirety, the sequence information on the Compact Disks (CDs) labeled Copy 1 and Copy 2. The CDs are formatted on IBM-PC, with operating system compatibility with MS-Windows. The files on each of the CDs are as follows:
Copy 1—Seqlist.txt 1,155 KB created Feb. 8, 2006; and
Copy 2—Seqlist.txt 1,155 KB created Feb. 8, 2006.

SUMMARY OF THE INVENTION

The present invention provides non-native glycosylation sites, oral formulations of polypeptide variants and hyperglycosylated or protease-resistant, hyperglycosylated polypeptide variants, which polypeptide variants comprise at least one mutated protease cleavage site in place of a native protease cleavage site found in a parent polypeptide, and thus exhibit increased protease resistance compared to the parent polypeptide, which polypeptide variants further include (1) a carbohydrate moiety covalently linked to at least one non-native glycosylation site not found in the parent protein therapeutic or (2) a carbohydrate moiety covalently linked to at least one native glycosylation site found but not glycosylated in the parent protein therapeutic. The present invention further provides compositions, including oral pharmaceutical compositions, comprising the hyperglycosylated or protease-resistant, hyperglycosylated polypeptide variants. The present invention further provides nucleic acids comprising nucleotide sequences encoding subject polypeptide agonists; and host cells comprising subject nucleic acids. The present invention further provides methods of treating viral infections, methods of treating fibrotic disorders, and methods of treating proliferative disorders, the methods generally involving administering to an individual in need thereof an effective amount of a subject polypeptide agonist. The present invention further provides containers, devices, and kits comprising the hyperglycosylated or protease-resistant, hyperglycosylated polypeptide variants. The present invention further provides therapeutic methods involving administering an effective amount of an oral pharmaceutical composition comprising a hyperglycosylated or protease-resistant, hyperglycosylated polypeptide variant to an individual in need thereof.

Features of the Invention

In one aspect, the invention provides oral pharmaceutical compositions comprising a known hyperglycosylated or protease-resistant, hyperglycosylated variant of a parent protein therapeutic.

In another aspect, the invention provides an oral pharmaceutical composition that contains a first number of moles of the known hyperglycosylated or protease-resistant, hyperglycosylated polypeptide variant in a first unit form, where a parenteral pharmaceutical composition containing a second number of moles of the parent protein therapeutic is proven to be effective in the treatment of a disease in a patient when administered to the patient by subcutaneous bolus injection in an amount where the patient receives the second number of moles of the parent protein therapeutic at a selected dosing interval, where the first number of moles is greater than the second number of moles, and where upon oral administration of the first unit form to the patient, the time required for release of the first number of moles of the hyperglycosylated or protease-resistant, hyperglycosylated variant is no greater than the time period of the selected dosing interval.

In another aspect, the invention provides an oral pharmaceutical composition that contains a first dose of the hyperglycosylated or protease-resistant, hyperglycosylated polypeptide variant in a first unit form, where a parenteral pharmaceutical composition containing a second dose of the parent protein therapeutic is proven to be effective in the treatment of a disease in a patient when administered to the patient by subcutaneous bolus injection of the second dose at a selected dosing interval, where the amount of the hyperglycosylated or protease-resistant, hyperglycosylated polypeptide variant in moles of drug per kilogram of patient body weight in the first dose is greater than the amount of the parent protein therapeutic in moles of drug per kilogram of patient body weight in the second dose when the first and second doses are calculated for the average patient body weight in the total population of patients suffering from the disease, and where upon oral administration of the first dose to the patient, the time required for release of all of the protease-resistant or protease-resistant, hyperglycosylated variant in the first dose is no greater than the period of time between doses in the selected dosing interval. In some embodiments, the parenteral pharmaceutical composition is proven to be effective in the treatment of the disease in the patient when administered to the patient in a weight-based dose at the selected dosing interval, i.e., the second dose is a weight-based dose and the parenteral pharmaceutical composition is in a form that allows weight-based dosing.

The present invention further provides therapeutic methods involving administering an effective amount of an oral pharmaceutical composition comprising a hyperglycosylated or protease-resistant, hyperglycosylated polypeptide variant to an individual in need thereof.

In another aspect, the invention provides a method of treating a disease in a patient comprising administering to the patient an oral pharmaceutical composition comprising a hyperglycosylated or protease-resistant, hyperglycosylated polypeptide variant of a parent protein therapeutic, where the oral pharmaceutical composition is administered orally to the patient in an amount whereby the patient receives a first dose of the hyperglycosylated or protease-resistant, hyperglycosylated polypeptide variant at a first dosing interval, where a parenteral pharmaceutical composition comprising the parent protein therapeutic is proven to be effective in the treatment of the disease in a patient when administered to the patient by subcutaneous bolus injection in an amount whereby the patient receives a second dose of the parent protein therapeutic at a second dosing interval, where the first dose in moles of the protease-resistant or protease-resistant, hyperglycosylated polypeptide variant per kilogram of patient body weight is greater than the second dose in moles of the parent protein therapeutic per kilogram of patient body weight when the first and second doses are calculated for the same patient body weight, and where upon oral administration of the first dose to the patient, the time required for release of all of the protease-resistant or protease-resistant, hyperglycosylated variant in the first dose is no greater than the period of time between doses in the second dosing interval. In some embodiments, the parenteral pharmaceutical composition is proven to be effective in the treatment of the disease in the patient when administered to the patient in a weight-based dose at the second dosing interval, i.e., the second dose is a weight-based dose and the parenteral pharmaceutical composition is in a form that allows weight-based dosing. In some of the foregoing embodiments, the first dose is a weight-based dose and the oral pharmaceutical composition is in a form that allows weight-based dosing.

In another aspect, the invention provides a method of treating a disease in a patient comprising administering to the patient an oral pharmaceutical composition comprising a hyperglycosylated or protease-resistant, hyperglycosylated polypeptide variant of a parent protein therapeutic, where the oral pharmaceutical composition is administered orally in an amount whereby the patient receives a first dose of the hyperglycosylated or protease-resistant, hyperglycosylated polypeptide variant at a first dosing interval, where a parenteral pharmaceutical composition comprising the parent protein therapeutic is proven to be effective in the treatment of the disease in a patient when administered to the patient by subcutaneous bolus injection in an amount whereby the patient receives a second dose of the parent protein therapeutic at a second dosing interval, where the first dose in moles of the protease-resistant or protease-resistant, hyperglycosylated polypeptide variant per kilogram of patient body weight is greater than the second dose in moles of the parent protein therapeutic per kilogram of patient body weight when the first and second doses are calculated for the same patient body weight, and where the time period between doses in the first dosing interval is the same as or shorter than the time period between doses in the second dosing interval. In some embodiments, the parenteral pharmaceutical composition is proven to be effective in the treatment of the disease in the patient when administered to the patient in a weight-based dose at the second dosing interval, i.e., the second dose is a weight-based dose and the parenteral pharmaceutical composition is in a form that allows weight-based dosing. In some of the foregoing embodiments, the first dose is a weight-based dose and the oral pharmaceutical composition is in a form that allows weight-based dosing.

In another aspect, the invention provides a method of treating a disease in a patient comprising administering to the patient an oral pharmaceutical composition in a first unit form comprising a first number of moles of a hyperglycosylated or protease-resistant, hyperglycosylated polypeptide variant of a parent protein therapeutic, where the first number of moles of the protease-resistant or protease-resistant, hyperglycosylated polypeptide variant is greater than a second number of moles of the parent protein therapeutic in a parenteral pharmaceutical composition, where the parenteral pharmaceutical composition is an immediate release formulation suitable for subcutaneous bolus injection, where the first unit form is administered orally to the patient at a first dosing interval that is the same as or shorter than a second dosing interval, and where the parent protein therapeutic is proven to be effective in the treatment of the disease in a patient when administered to the patient by subcutaneous bolus injection of the parenteral pharmaceutical composition in an amount whereby the patient receives the second number of moles of the parent protein therapeutic at the second dosing interval.

Further Features of the Invention

In one aspect, the invention provides for a variant of a parent Type 1 interferon, wherein the variant comprises at least one amino acid substitution compared to the parent Type 1 interferon, wherein the at least one amino acid substitution is selected from the group consisting of D31N, L31S, D31N, K31N, D102N, S102N, T102N, R102N, I102N, D108N, E108N, K108N, E138T, G138T, I138T, L138T, and P138T wherein the at least one amino acid substitution generates a glycosylation site.

In one aspect of the invention, the parent Type I interferon is selected from the group consisting of interferon α (IFN α), interferon β (IFN β), interferon κ (IFN-κ), interferon ω (IFN ω), interferon τ (IFN τ) and a hybrid Type 1 interferon.

In one aspect of the invention, the interferon α is interferon alfacon-1 and the variant is selected from the group consisting of [D102N]interferon alfacon-1, [D108N]interferon alfacon-1, [E138N]interferon alfacon-1, [D102N, D108N]interferon alfacon-1, [D102N, E138T]interferon alfacon-1, [D108N, E138N]interferon alfacon-1, and [D102N, D108N, E138N] interferon alfacon-1. In some embodiment, the variant comprises a consensus amino acid sequence as set forth in SEQ ID Nos:2137-2151.

In one aspect of the invention, the interferon α is interferon α1 and the variant is selected from the group consisting of [D31N]interferon α1, [D102N]interferon α1, [D108N]interferon α1, [G138T]interferon α1, [D31N, D102N]interferon α1, [D31N, D108N]interferon α1, [D31N, G138T]interferon α1, [D102N, D108N]interferon α1, [D102N; G138T]interferon α1, [D108N, G138T]interferon α1, [D31N, D102N, D108N]interferon α1, [D31N, D102N, G138T]interferon α1, [D31N, D108N, G138T]interferon α1, [D102N, D108N, G138T]interferon α1, and [D31N, D102N, D108N, G138T] interferon α1. In some embodiments, the variant comprises an amino acid sequence as set forth in any one of SEQ ID Nos:1407-1421.

In one aspect of the invention, the interferon α is interferon α2a and the variant is selected from the group consisting of [D31N]interferon α2a, [D102N]interferon α2a, [D108N]interferon α2a, [D31N, D102N]interferon α2a, [D31N, D108N]interferon α2a, [D102N, D108N]interferon α2a, [D31N, D102N, D108N]interferon α2a. In some embodiments, the variant comprises an amino acid sequence as set forth in any one of SEQ ID Nos:1423-1433.

In one aspect of the invention, the interferon α is interferon α2b and the variant is selected from the group consisting of [D31N]interferon α2b, [D102N] interferon α2b, [D108N] interferon α2b, [D31N, D102N]interferon α2b, [D31N, D108N]interferon α2b, [D102N, D108N]interferon α2b, [D31N, D102N, D108N]interferon α2b. In some embodiments, the variant comprises an amino acid sequence as set forth in any one of SEQ ID Nos:1439-1449.

In one aspect of the invention, the interferon α is interferon α4a and the variant is selected from the group consisting of [D31N]interferon α4a, [D102N]interferon α4a, [E108N]interferon α4a, [E138T]interferon α4a, [D31N, D102N]interferon α4a, [D31N, E108N]interferon α4a, [D31N, E138T] interferon α4a, [D102N, E108N]interferon α4a, [D102N, E138T]interferon α4a, [E108N, E138T]interferon α4a, [D31N, D102N, E108N]interferon α4a, [D31N, D102N, E138T]interferon α4a, [D31N, E108N, E138T]interferon α4a, [D102N, E108N, E138T]interferon α4a, and [D31N, D102N, E108N, E138T]interferon α4a. In some embodiments, the variant comprises an amino acid sequence as set forth in any one of SEQ ID Nos: 1455-1469.

In one aspect of the invention, the interferon α is interferon α4b and the variant is selected from the group consisting of [D31N] interferon α4b, [D102N] interferon α4b, [E108N] interferon α4b, [E138T]interferon α4b, [D31N, D102N]interferon α4b, [D31N, E108N]interferon α4b, [D31N, E138T]interferon α4b, [D102N, E108N]interferon α4b, [D102N, E138T]interferon α4b, [E108N, E138T]interferon α4b, [D31N, D102N, E108N]interferon α4b, [D31N, D102N, E138T]interferon α4b, [D31N, E108N, E138T]interferon α4b, [D102N, E108N, E138T]interferon α4b, and [D31N, D102N, E108N, E138T]interferon α4b. In some embodiments, the variant comprises an amino acid sequence as set forth in any one of SEQ ID Nos:1471-1485.

In one aspect of the invention, the interferon α is interferon α5 and the variant is selected from the group consisting of [D31N]interferon α5, [D102N]interferon α5, [D108N]interferon α5, [E138T]interferon α5, [D31N, D102N]interferon α5, [D31N, D108N]interferon α5, [D31N, E138T]interferon α5, [D102N, D108N]interferon α5, [D102N, E138T]interferon α5, [D108N, E138T]interferon α5, [D31N, D102N, D108N]interferon α5, [D31N, D102N, E138T]interferon α5, [D31N, D108N, E138T]interferon α5, [D102N, D108N, E138T]interferon α5, and [D31N, D102N, D108N, E138T] interferon α5. In some embodiments, the variant comprises an amino acid sequence as set forth in any one of SEQ ID Nos:1487-1501.

In one aspect of the invention, the interferon α is interferon α6 and the variant is selected from the group consisting of [D31N]interferon α6, [D102N]interferon α6, [D108N]interferon α6, [G138T]interferon α6, [D31N, D102N]interferon α6, [D31N, D108N]interferon α6, [D31N, G138T]interferon α6, [D102N, D108N]interferon α6, [D102N, G138T]interferon α6, [D108N, E138T]interferon α6, [D31N, D102N, D108N]interferon α6, [D31N, D102N, G138T]interferon α6, [D31N, D108N, G138T]interferon α6, [D102N, D108N, G138T]interferon α6, and [D31N, D102N, D108N, G138T] interferon α6. In some embodiments, the variant comprises an amino acid sequence as set forth in any one of SEQ ID Nos:1503-1517.

In one aspect of the invention, the interferon α is interferon α7 and the variant is selected from the group consisting of [D31N]interferon α7, [D102-N]interferon α7, [E108N]interferonα7, [E138T]interferonα7, [D31N, D102N]interferonα7, [D31N, E108N]interferon α7, [D31N, E138T]interferon α7, [D102N, E108N]interferon α7, [D102N, E138T]interferon α7, [D108N, E138T]interferon α7, [D31N, D102N, E108N] interferon α7, [D31N, D102N, E138T]interferon α7, [D31N, E108N, E138T]interferon α7, [D102N, E108N, E138T]interferon α7, and [D31N, D102N, E108N, E138T]interferon α7. In some embodiments, the variant comprises an amino acid sequence as set forth in any one of SEQ ID Nos:1519-1533.

In one aspect of the invention, the interferon α is interferon α8 and the variant is selected from the group consisting of [D31N]interferon α8, [D102N]interferon α8, [D108N]interferon α8, [I138T]interferon α8, [D31N, D102N]interferon α8, [D31N, D108N]interferon α8, [D31N, I138T]interferon α8, [D102N, D108N]interferon α8, [D102N, I138T]interferon α8, [D108N, I138T]interferon α8, [D31N, D102N, D108N]interferon α8, [D31N, D102N, I138T]interferon α8, [D31N, D108N, I138T]interferon α8, [D102N, D108N, I138T]interferon α8, and [D31N, D102N, D108N, I138T]

interferon α8. In some embodiments, the variant comprises an amino acid sequence as set forth in any one of SEQ ID Nos:1535-1549.

In one aspect of the invention, the interferon α is interferon α10 and the variant is selected from the group consisting of [D31N]interferon α10, [D102N]interferon 10, [E108N]interferon α10, [E138T]interferon α10, [D31N, D102N]interferon α10, [D31N, E108N]interferon α10, [D31N, E138T] interferon α10, [D102N, E108N]interferon α10, [D102N, E138T]interferon α10, [D108N, E138T]interferon α10, [D31N, D102N, E108N]interferon α10, [D31N, D102N, E138T]interferon α10, [D31N, E108N, E138T]interferon α10, [D102N, E108N, E138T]interferon α10, and [D31N, D102N, E108N, E138T]interferon α10. In some embodiments, the variant comprises an amino acid sequence as set forth in any one of SEQ ID Nos:1551-1565.

In one aspect of the invention, the interferon α is interferon α 13 and the variant is selected from the group consisting of [D31N] interferon α113, [D102N] interferon α13, [D108N] interferon α13, [G138T]interferon α13, [D31N, D102N]interferon α13, [D31N, D108N]interferon α13, [D31N, G138T]interferon α13, [D102N, D108N]interferon α13, [D102N, G138T]interferon α13, [D108N, E138T]interferon α13, [D31N, D102N, D108N]interferon α13, [D31N, D102N, G138T]interferon α13, [D31N, D108N, G138T]interferon α13, [D102N, D108N, G138T]interferon α13, and [D31N, D102N, D108N, G138T]interferon α13. In some embodiments, the variant comprises an amino acid sequence as set forth in any one of SEQ ID Nos:1567-1581.

In one aspect of the invention, the interferon α is interferon α14 and the variant is selected from the group consisting of [D108N]interferon α14, [E138T]interferon α14, and [D108N, E138T]interferon α14. In some embodiments, the variant comprises an amino acid sequence as set forth in any one of SEQ ID Nos:1585-1592.

In one aspect of the invention, the interferon α is interferon α16 and the variant is selected from the group consisting of [D31N]interferon α16, [D102N]interferon α16, [D108N]interferon α16, [E138T]interferon α16, [D31N, D102N]interferon α16, [D31N, D108N]interferon α16, [D31N, E138T] interferon α16, [D102N, D108N]interferon α16, [D102N, E138T]interferon α16, [D108N, E138T]interferon α16, [D31N, D102N, D108N]interferon α16, [D31N, D102N, E138T]interferon α16, [D31N, D108N, E138T]interferon α16, [D102N, D108N, E138T]interferon α16, and [D31N, D102N, D108N, E138T]interferon α16. In some embodiments, the variant comprises an amino acid sequence as set forth in any one of SEQ ID Nos:1599-1613.

In one aspect of the invention, the interferon α is interferon α 17 and the variant is selected from the group consisting of [D31N]interferon α17, [D102N]interferon α17, [E108N]interferon α17, [E138T]interferon α17, [D31N, D102N]interferon α17, [D31N, E108N]interferon α17, [D31N, E138T] interferon α17, [D102N, E108N]interferon α17, [D102N, E138T]interferon α17, [D108N, E138T]interferon α17, [D31N, D102N, E108N]interferon α17, [D31N, D102N, E138T]interferon α17, [D31N, E108N, E38T]interferon α17, [D102N, E108N, E138T]interferon α17, and [D31N, D102N, E108N, E138T]interferon α17. In some embodiments, the variant comprises an amino acid sequence as set forth in any one of SEQ ID Nos:1615-1629.

In one aspect of the invention, the interferon α is interferon α21 and the variant is selected from the group consisting of [D31N] interferon α21, [D102N] interferon α21, [E108N] interferon α21, [E138T]interferon α21, [D31N, D102N]interferon α21, [D31N, E108N]interferon α21, [D31N, E138T]interferon α21, [D102N, E108N]interferon α21, [D102N, E138T]interferon α21, [D108N, E138T]interferon α21, [D31N, D102N, E108N]interferon α21, [D31N, D102N, E138T]interferon α21, [D31N, E108N, E138T]interferon α21, [D102N, E108N, E138T]interferon α21, and [D31N, D102N, E108N, E138T]interferon α21. In some embodiments, the variant comprises an amino acid sequence as set forth in any one of SEQ ID Nos:1631-1645.

In one aspect of the invention, the interferon α is interferon αH and the variant is selected from the group consisting of [D108N]interferon αH, [E138T]interferon αH, and [D108N, E138T]interferon αH. In some embodiments, the variant comprises an amino acid sequence as set forth in any one of SEQ ID Nos:1649-1656.

In one aspect of the invention, the interferon α is interferon αI and the variant is selected from the group consisting of [D31N]interferon αI, [D102N]interferon αI, [E108N]interferon αI, [E138T]interferon αI, [D31N, D102N]interferon αI, [D31N, E108N]interferon αI, [D31N, E138T]interferon αI, [D102N, E108N]interferon αI, [D102N, E138T]interferon αI, [D108N, E138T]interferon αI, [D31N, D102N, E108N]interferon αI, [D31N, D102N, E138T]interferon αI, [D31N, E108N, E138T]interferon αI, [D102N, E108N, E138T]interferon αI, and [D31N, D102N, E108N, E138T] interferon αI. In some embodiments, the variant comprises an amino acid sequence as set forth in any one of SEQ ID Nos:1663-1677.

In one aspect of the invention, interferon α is interferon αJ1 and the variant is selected from the group consisting of [D31N]interferon αJ1, [D102N]interferon αJ1, [E108N]interferon αJ1, [E138T]interferon αJ1, [D31N, D102N]interferon αJ1, [D31N, E108N]interferon αJ1, [D31N, E138T] interferon αJ1, [D102N, E108N]interferon αJ1, [D102N, E138T]interferon αJ1, [D108N, E138T]interferon αJ1, [D31N, D102N, E108N]interferon αJ1, [D31N, D102N, E138T]interferon αJ1, [D31N, E108N, E138T]interferon αJ1, [D102N, E108N, E138T]interferon αj1, and [D31N, D102N, E108N, E138T]interferon αJ1. In some embodiments, the variant comprises an amino acid sequence as set forth in any one of SEQ ID Nos: 1678-1693.

In one aspect of the invention, the variant is selected from the group consisting of [L31S]interferon-β, [S102N]interferon-β, [E138T]interferon-β, [L31S, S102N]interferon-β, [L31S, E138T]interferon-β, [S102N, E138T]interferon-β, and [L31S, S102N, E138T]interferon-β. In some embodiments, the variant comprises an amino acid sequence as set forth in any one of SEQ ID Nos:1695-1706.

In one aspect of the invention, the variant is selected from the group consisting of [L31S]interferon κ, [T102N]interferon κ, [K108N]interferon κ, [P138T]interferon κ, [L31S, T102N]interferon κ, [L31S, K108N]interferon κ, [L31S, P138T]interferon κ, [T102N, K108N]interferon κ, [T102N, P138T]interferon κ, [K108N, P138T]interferon K, [L31S, T102N, K108N]interferon κ, [L31S, T102N, P138T]interferon κ, [L31S, K108N, P138T]interferon κ, [T102N, K108N, P138T]interferon κ, and [L31S, T102N, K108N, P138T]interferon κ. In some embodiments, the variant comprises an amino acid sequence as set forth in any one of SEQ ID Nos:1711-1725.

In one aspect of the invention, the variant is selected from the group consisting of [D31N]interferon ω, [R102N]interferon ω, [G138T]interferon c, [D31N, R102N]interferon ω, [D31N, G138T]interferon ω, [R102N, G138T]interferon ω, [D31N, R102N, G138T]interferon ω. In some embodiments, the variant comprises an amino acid sequence as set forth in any one of SEQ ID Nos:1727-1738.

In one aspect of the invention, the variant is selected from the group consisting of [K31N]interferon τ, [I102N]interferon τ, [E108N]interferon τ, [L138T]interferon τ, [K31N, I102N]interferon τ, [K31N, E108N]interferon τ, [K31N, L138T]interferon τ, [I102N, E108N]interferon τ, [I102N, L138T]interferon τ, [E108N, L138T]interferon τ, [K31N, I102N, E108N]interferon τ, [K31N, I102N, L138T]interferon τ, [K31N, E108N, L138T]interferon τ, [I102N, E108N, L138T]interferon τ, and [K31N, I102N, E108N, L138T]interferon τ. In some embodiments, the variant comprises an amino acid sequence as set forth in any one of SEQ ID Nos:1743-1757.

In one aspect of the invention, the variant comprises a carbohydrate moiety covalently linked to a non-native glycosylation site.

In one aspect of the invention, a polypeptide comprising a carrier peptide set forth in Table 9 wherein the polypeptide is a native Type 1 interferon comprising an amino acid sequence as set forth in any one of SEQ ID Nos:1406, 1422, 1438, 1454, 1470, 1486, 1502, 1518, 1534, 1550, 1566, 1582, 1598, 1614, 1630, 1646, 1662, 1678, 1694, 1710, 1726, 1742, and 1758. In some embodiments, the polypeptide binds erythropoietin receptor. In some embodiments, the polypeptide comprises an amino acid sequence as set forth in SEQ ID Nos: 1774-1775.

In one aspect, the invention provides for the above described variants wherein the variant comprises a carrier peptide set forth in Table 9.

In one aspect, the invention provides for a pharmaceutical composition comprising the above described variants, and a pharmaceutically acceptable excipient. In some embodiments, the pharmaceutically-acceptable excipient is suitable for oral delivery. In some embodiments, the pharmaceutically-acceptable excipient is suitable for parenteral delivery.

In one aspect, the invention provides for a polynucleotide comprising a nucleotide sequence encoding any of the above described variants. In some embodiments, the polynucleotide comprises codons corresponding to mammalian codon usage bias.

In one aspect, the invention provides for an expression vector comprising the above described polynucleotides operably linked to a promoter functional in a eukaryotic cell.

In one aspect, the invention provides for a host cell comprising the above described polynucleotides.

In one aspect, the invention provides for a host cell comprising the above described expression vector.

In one aspect, the invention provides for the above described host cells, wherein the host cell is a eukaryotic cell.

In one aspect, the invention provides for a method for producing the above described variants, the method comprising: culturing the above described host cell under conditions that favor production of the variant; and isolating the synthetic Type I interferon receptor polypeptide agonist from the culture.

In one aspect, the invention provides for a method of treating a disorder amenable to treatment with a Type 1 interferon, the method comprising administering to an individual in need thereof a therapeutically effective amount of one of the above described variants.

In one aspect, the invention provides for a method of prophylactically treating a disorder amenable to treatment with a Type 1 interferon, the method comprising administering to an individual in need thereof a prophylactically effective amount of one of the above described variants. In some embodiments, the disorder is a fibrotic disorder. In some embodiments, the disorder is cancer. In some embodiments, the disorder is multiple sclerosis. In some embodiments, the variant is a variant of a parent interferon-β. In some embodiments, the cancer is selected from the group consisting of malignant melanoma, renal cell carcinoma, multiple myeloma and leukemia. In some embodiments, the disorder is a viral infection. In some embodiments, the viral infection is caused by a virus of family Flaviviridae. In some embodiments, the virus of family Flaviviridae is selected from the group consisting of yellow fever virus, West Nile virus, dengue fever virus, and hepatitis C virus. In some embodiments, the virus of family Flaviviridae is hepatitis C virus.

In one aspect, the invention provides for a therapeutically effective amount of one of the above described variants administered to the individual at a dosing interval selected from the group consisting of once a week, twice a week, and three times a week. In some embodiments, the therapeutically effective amount is administered to the individual at a dosing interval of once a week. In some embodiments, the therapeutically effective amount is administered to the individual on one occasion. In some embodiments, the therapeutically effective amount is administered to the individual by subcutaneous injection. In some embodiments, the therapeutically effective amount is administered to the individual intravenously. In some embodiments, the therapeutically effective amount is administered to the individual orally. In some embodiments, the therapeutically effective amount is administered to the individual intramuscularly.

In one aspect, the invention provides for the above described embodiments, wherein the individual is a human.

BRIEF DESCRIPTION OF THE DRAWINGS

FIG. 1 depicts an amino acid sequence of human mature IFN-α2a.

FIG. 2 depicts an amino acid sequence of human mature IFN-α2b.

FIG. 3 depicts an amino acid sequence of human IFN-β.

FIG. 4 depicts an amino acid sequence of native human IFN-γ.

FIG. 5 depicts an amino acid sequence of G-CSF.

FIG. 6 depicts an amino acid sequence of human growth hormone.

FIG. 7 depicts an amino acid sequence of erythropoietin.

FIG. 8 depicts an amino acid sequence of GM-CSF.

FIG. 9 depicts an amino acid sequence of a consensus IFN-α.

FIG. 10 depicts an amino acid sequence of IFN-α.

FIG. 11 depicts an amino acid sequence of IFN-α2c.

FIG. 12 depicts an amino acid sequence of IFN-αd.

FIG. 13 depicts an amino acid sequence of IFN-α5.

FIG. 14 depicts an amino acid sequence of IFN-α6.

FIG. 15 depicts an amino acid sequence of IFN-α4.

FIG. 16 depicts an amino acid sequence of IFN-α4b.

FIG. 17 depicts an amino acid sequence of IFN-αI.

FIG. 18 depicts an amino acid sequence of IFN-αJ.

FIG. 19 depicts an amino acid sequence of IFN-αH.

FIG. 20 depicts an amino acid sequence of IFN-αF.

FIG. 21 depicts an amino acid sequence of IFN-α8.

FIG. 22 depicts an amino acid sequence of IFN-β1.

FIG. 23 depicts an amino acid sequence of IFN-β2a.

FIG. 24 depicts an amino acid sequence comparison of Infergen (SEQ ID NO:1356) and Type I Interferon species (human IFN-α2b, SEQ ID NO:1357; human IFN-α14, SEQ ID NO:1358; human IFN-β1, SEQ ID NO:1359; human IFN-ω1, SEQ ID NO:1360) that have been reported to be glycosylated naturally. The amino acid residues where the glycosylations occur are labeled with bold outlined boxes. The asparagines residues are the anchoring site for N-linked glycosylation and the threonine residue is the anchoring site for O-linked glycosylation. FIG. 24 also depicts a majority sequence (SEQ ID NO:1355) based on the comparison.

FIG. 25 depicts an amino acid sequence comparison of amino acids 61-120 of Infergen (SEQ ID NO:1362) and exemplary synthetic Type I interferon receptor polypeptide agonists. Sites 1, 2 and 3 are examples of positions where glycosylation sites are created. N-linked glycosylation sites are generated at Sites 1 and 2. Both N-linked and O-linked glycosylation sites are generated at Site 3.

FIG. 26 depicts a synthetic mammalian Infergen nucleic acid sequence with preferred mammalian codon usage; and the translated open reading frame. The open reading frame is indicated with translated Infergen amino acid sequence (SEQ ID NO: 1356). Six pairs of complementary primers from A to F are shown in alternating italics and bold text. The upper sense strands of the primer pairs are identified with odd number and lower non-sense strands are identified with even number. In the region upstream of the start codon ATG, a short sequence of GCCACC, the Kozak consensus sequence, is designed to increase eukaryotic translation efficiency. Two tandem stop codons—TAA and TGA—are used to ensure complete termination of translation.

FIG. 27 depicts a comparison of the nucleic acid sequences of mammalian Infergen and glycosylated mutants thereof. The nucleotides that differ are shown in boxes. Codons used based on the preferred codon usage set forth in Table 8.

FIG. 28 depicts an amino acid sequence comparison of amino acids 81-140 of human IFN-β1 (SEQ ID NO:1391) and exemplary glycosylated variants of human IFN-β1. Sites 1 and 2 are the positions where glycosylation mutants are generated. In general, only N-linked glycosylation sites are created at Site 1. Both N-linked and O-linked glycosylation sites are generated at Site 2. The naturally occurring N-linked glycosylation sites in human IFN-β1 and mutants are shown in boxes.

FIG. 29 depicts an amino acid sequence comparison of amino acids 81-140 of human IFN-α1 (SEQ ID NO:1398) and exemplary glycosylated variants of human IFN-ω1. Sites 1 and 2 are the positions where glycosylation mutants are generated. In general, only N-linked glycosylation sites are created at Site 1. Both N-linked and O-linked glycosylation sites are generated at Site 2. The naturally occurring N-linked glycosylation sites in human IFN-ω1 and mutants are shown in boxes.

FIG. 31 depicts the amino acid sequence of mature, native human IFN-γ (SEQ ID NO:1404).

FIG. 33 depicts the amino acid and nucleic sequences of Type 1 interferons, Type 1 interferon glycosylation variants, erythropoeitin, and darbepoetin alfa (SEQ ID NOs:1406-2153).

FIG. 34a-f depicts an amino acid sequence alignment of the human type I interferon (IFN) precursors and the fusion protein of consensus IFN-αCon1 with human IFN α14 signal peptide (Infergen w A14 Sig). The interferon sequences that are aligned in FIG. 34a-f are: IFN-α1 (SEQ ID NO:1406), IFN-α2a (SEQ ID NO:1422), IFN-α2b (SEQ ID NO:1438), IFN-α4a (SEQ ID NO:1454), IFN-α4b (SEQ ID NO:1470), IFN-α5 (SEQ ID NO:1486), IFN-α6 (SEQ ID NO:1502), IFN-α7 (SEQ ID NO:1518), IFN-α8 (SEQ ID NO:1534), IFN-α10 (SEQ ID NO:1550), IFN-α13 (SEQ ID NO:1566), IFN-α14 (SEQ ID NO:1582), IFN-α16 (SEQ ID NO:1598), IFN-α17 (SEQ ID NO:1614), IFN-α21 (SEQ ID NO:1630), IFN-αH (SEQ ID NO:1646), IFN-αI (SEQ ID NO:1662), IFN-αJ1 (SEQ ID NO:1678), IFN beta 1 (SEQ ID NO:1694), IFN kappa (SEQ ID NO:1710), IFN omega 1 (SEQ ID NO:1726), IFN tau (SEQ ID NO:1742), and Infergen (SEQ ID NO:1758). The majority sequence is shown above.

DEFINITIONS

Figure 30:
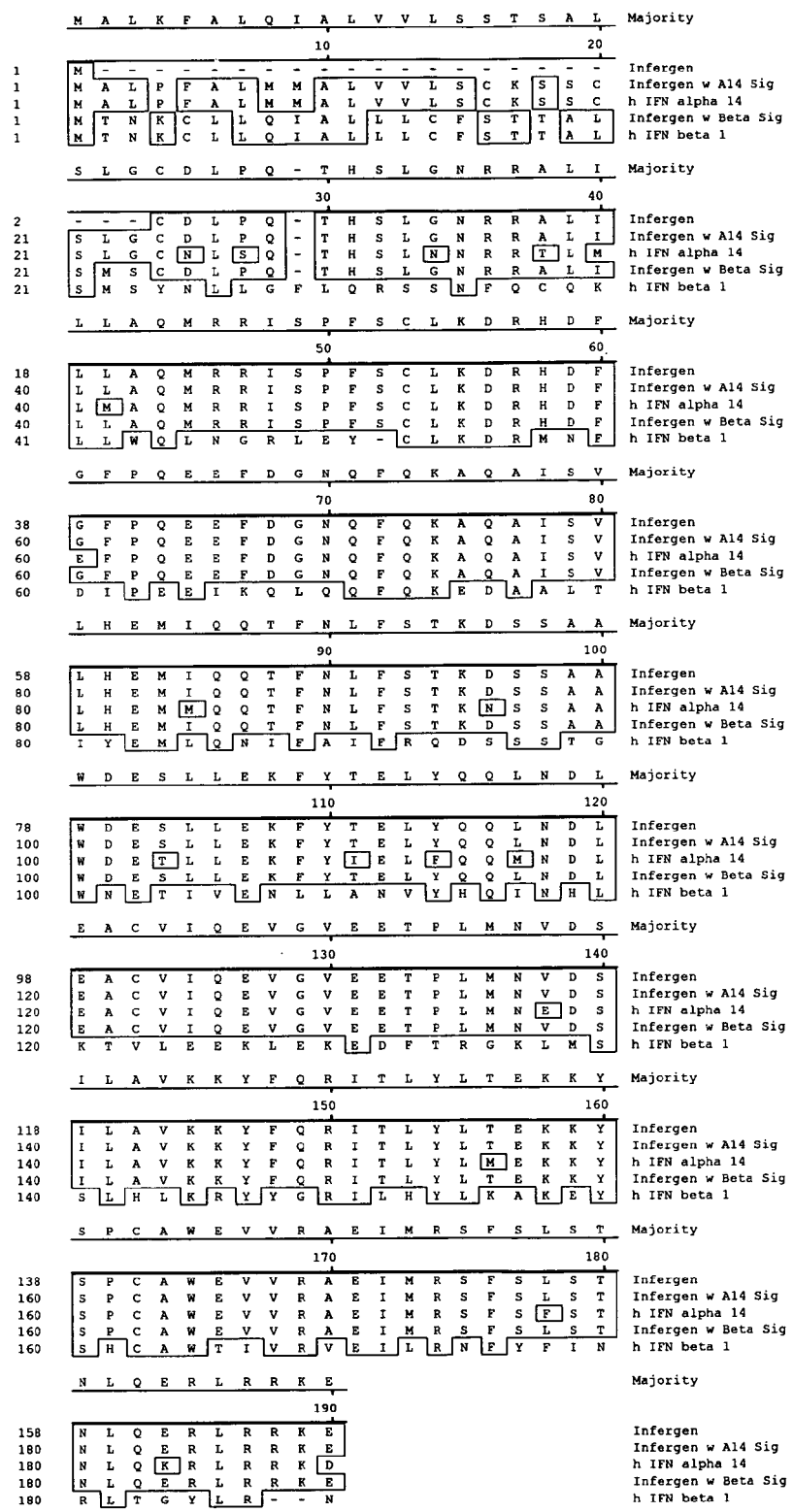
FIG. 30 depicts an amino acid sequence alignment of Infergen (SEQ ID NO:1356), human IFN-α14 (SEQ ID NO:1358), human IFN-11 (SEQ ID NO:1359), and exemplary fusion proteins with human IFN-α14 and human IFN-β signal peptides (SEQ ID NOs:1388 and 1389, respectively). The majority sequence is shown above (SEQ ID NO:1387).

The term "polypeptide" refers to a polymer of amino acids and does not refer to a specific length of the product; thus, peptides, oligopeptides, and proteins are included within the definition of polypeptide. This term also does not refer to or exclude post-translational modifications of the polypeptide, for example, glycosylations, acetylations, phosphorylations and the like. Included within the term "polypeptide" are, for example, polypeptides containing one or more analogs of an amino acid (including, for example, unnatural amino acids, non-coded amino acids, etc.), polypeptides with substituted linkages, as well as other modifications known in the art, both naturally occurring and non-naturally occurring. The term "polypeptide" includes fusion proteins, including, but not limited to, fusion proteins with a heterologous amino acid sequence, fusions with heterologous and homologous leader sequences, with or without N-terminal methionine residues; immunologically tagged proteins; and the like.

The terms "polynucleotide" and "nucleic acid molecule" are used interchangeably herein to refer to polymeric forms of nucleotides of any length. The polynucleotides may contain deoxyribonucleotides, ribonucleotides, and/or their analogs. Nucleotides may have any three-dimensional structure, and may perform any function, known or unknown. The term "polynucleotide" includes single-, double-stranded and triple helical molecules. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as oligomers or oligos and may be isolated from genes, or chemically synthesized by methods known in the art. The term "polynucleotide" includes double-stranded DNA found, inter alia, in linear DNA molecules (e.g., restriction fragments), viruses, plasmids, and chromosomes.

The following are non-limiting embodiments of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes, and primers. A nucleic acid molecule may also comprise modified nucleic acid molecules, such as methylated nucleic acid molecules and nucleic acid molecule analogs. Analogs of purines and pyrimidines are known in the art. Nucleic acids may be naturally occurring, e.g. DNA or RNA, or may be synthetic analogs, as known in the art. Such analogs may be preferred for use as probes because of superior stability under assay conditions. Modifications in the native structure, including alterations in the backbone, sugars or heterocyclic bases, have been shown to increase intracellular stability and binding affinity. Among useful changes in the backbone chemistry are phosphorothioates; phosphorodithioates, where both of the non-bridging oxygens are substituted with sulfur; phosphoroamidites; alkyl phosphotriesters and boranophosphates. Achiral phosphate derivatives include 3'-O'-5'-S-phosphorothioate, 3'-S-5'-O-phosphorothioate, 3'-CH$_2$-5'-O-phosphonate and 3'-NH-5'-O-phosphoroamidate. Peptide nucleic acids replace the entire ribose phosphodiester backbone with a peptide linkage.

A polynucleotide or polypeptide has a certain percent "sequence identity" to another polynucleotide or polypeptide, meaning that, when aligned, that percentage of bases or amino acids are the same when comparing the two sequences. Sequence similarity can be determined in a number of different manners. To determine sequence identity, sequences can be aligned using the methods and computer programs, including BLAST, available over the world wide web at ncbi.nlm.nih.gov/BLAST. See, e.g., Altschul et al. (11020), *J. Mol. Biol.* 215:403-10. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (11026), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See *Meth. Mol. Biol.* 70: 173-187 (11027). Also, the GAP program using the Needleman and Wunsch alignment method can be utilized to align sequences. See *J. Mol. Biol.* 48: 443-453 (1970)

The term "host cell" includes an individual cell or cell culture, which can be or has been a recipient of any recombinant vector(s) or synthetic or exogenous polynucleotide. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo or in vitro with a recombinant vector or a synthetic or exogenous polynucleotide. A host cell which comprises a recombinant vector of the invention is a "recombinant host cell." In some embodiments, a host cell is a prokaryotic cell. In other embodiments, a host cell is a eukaryotic cell.

The terms "DNA regulatory sequences," and "regulatory elements," used interchangeably herein, refer to transcriptional and translational control sequences, such as promoters, enhancers, polyadenylation signals, terminators, protein degradation signals, and the like, that provide for and/or regulate expression of a coding sequence and/or production of an encoded polypeptide in a host cell.

The term "transformation" is used interchangeably herein with "genetic modification" and refers to a permanent or transient genetic change induced in a cell following introduction of new nucleic acid (i.e., DNA exogenous to the cell). Genetic change ("modification") can be accomplished either by incorporation of the new DNA into the genome of the host cell, or by transient or stable maintenance of the new DNA as an episomal element. Where the cell is a mammalian cell, a permanent genetic change is generally achieved by introduction of the DNA into the genome of the cell.

The term "operably linked," as used herein, refers to a juxtaposition wherein the components so described are in a relationship permitting them to function in their intended manner. For instance, a promoter is operably linked to a coding sequence if the promoter effects transcription or expression of the coding sequence.

The term "construct," as used herein, refers to a recombinant nucleic acid, generally recombinant DNA, that has been generated for the purpose of the expression of a specific nucleotide sequence(s), or is to be used in the construction of other recombinant nucleotide sequences.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse affect attributable to the disease. "Treatment," as used herein, covers any treatment of a disease in a mammal, particularly in a human, and includes: (a) increasing survival time; (b) decreasing the risk of death due to the disease; (c) preventing the disease from occurring in a subject which may be predisposed to the disease but has not yet been diagnosed as having it; (d) inhibiting the disease, i.e., arresting its development (e.g., reducing the rate of disease progression); and (e) relieving the disease, i.e., causing regression of the disease.

The terms "individual," "host," "subject," and "patient," used interchangeably herein, refer to a mammal, including primates, rodents, livestock, pets, horses, etc. In some embodiments, an individual is a human.

The term "therapeutically effective amount" is meant an amount of a therapeutic agent, or a rate of delivery of a therapeutic agent, effective to facilitate a desired therapeutic effect. The precise desired therapeutic effect will vary according to the condition to be treated, the formulation to be administered, and a variety of other factors that are appreciated by those of ordinary skill in the art.

As used herein, the terms "proven to be effective" in the context of a drug therapy for treatment of a disease, or any language of similar meaning, shall be understood to mean that the drug therapy so described was found to be safe and effective, alone or in combination with one or more additional pharmaceutical agent(s), for the treatment of the disease in a controlled clinical trial or set of clinical trials that achieved one or more of the primary clinical endpoints of the trial(s) with a statistical significance of $p \leq 0.05$. Typically, drug therapies proven to be effective for a drug include: (1) any treatment indication(s) for the drug specified in a license to market the drug granted by a regulatory authority; and (2) any treatment indication(s) for the drug described in a statement issued by a generally recognized body of medical experts (e.g. an NIH Consensus Statement).

The term "binds specifically," in the context of antibody binding, refers to high avidity and/or high affinity binding of an antibody to a specific polypeptide i.e., epitope of a polypeptide, e.g., a subject synthetic Type I interferon receptor polypeptide agonist. For example, antibody binding to an epitope on a specific a subject synthetic Type I interferon receptor polypeptide agonist or fragment thereof is stronger than binding of the same antibody to any other epitope, particularly those which may be present in molecules in association with, or in the same sample, as the specific polypeptide of interest, e.g., binds more strongly to a specific subject synthetic Type I interferon receptor polypeptide agonist epitope than to any other Type I interferon receptor polypeptide agonist epitope so that by adjusting binding conditions the antibody binds almost exclusively to the specific subject synthetic Type I interferon receptor polypeptide agonist epitope and not to any other Type I interferon receptor polypeptide agonist epitope, or to any other polypeptide which does not comprise the epitope. Antibodies that bind specifically to a polypeptide may be capable of binding other polypeptides at a weak, yet detectable, level (e.g., 10% or less of the binding shown to the polypeptide of interest). Such weak binding, or background binding, is readily discernible from the specific antibody binding to a subject polypeptide, e.g. by use of appropriate controls. In general, specific antibodies bind to a given polypeptide with a binding affinity of $10^{-7}$ M or more, e.g., $10^{-8}$ M or more (e.g., $10^{-9}$ M, $10^{-10}$ M, $10^{-11}$ M, etc.). In general, an antibody with a binding affinity of $10^{-6}$ M or less is not useful in that it will not bind an antigen at a detectable level using conventional methodology currently used.

A "fibrotic condition," "fibrotic disease" and "fibrotic disorder" are used interchangeably to refer to a condition, disease or disorder that is amenable to treatment by administration of a compound having anti-fibrotic activity. Fibrotic disorders include, but are not limited to, pulmonary fibrosis, including idiopathic pulmonary fibrosis (IPF) and pulmonary fibrosis from a known etiology, liver fibrosis, and renal fibrosis. Other exemplary fibrotic conditions include musculoskeletal fibrosis, cardiac fibrosis, post-surgical adhesions, scleroderma, glaucoma, and skin lesions such as keloids.

The term "proliferative disorder" and "proliferative disease" are used interchangeably to refer to any disease or condition characterized by pathological cell growth or proliferation, particularly cancer.

The terms "cancer," "neoplasm," and "tumor" are used interchangeably herein to refer to cells that exhibit relatively autonomous growth, so that they exhibit an aberrant growth phenotype characterized by a significant loss of control of cell proliferation. Cancerous cells can be benign or malignant.

The term "hepatitis virus infection" refers to infection with one or more of hepatitis A, B, C, D, or E virus, with blood-borne hepatitis viral infection being of particular interest, particularly hepatitis C virus infection.

The term "sustained viral response" (SVR; also referred to as a "sustained response" or a "durable response"), as used herein, refers to the response of an individual to a treatment regimen for HCV infection, in terms of serum HCV titer. Generally, a "sustained viral response" refers to no detectable HCV RNA (e.g., less than about 500, less than about 200, or less than about 100 genome copies per milliliter serum) found in the patient's serum for a period of at least about one month, at least about two months, at least about three months, at least about four months, at least about five months, or at least about six months following cessation of treatment.

The term "treatment failure patients" (or "treatment failures") as used herein generally refers to HCV-infected patients who failed to respond to previous therapy for HCV (referred to as "non-responders") or who initially responded to previous therapy, but in whom the therapeutic response was not maintained (referred to as "relapsers"). The previous therapy generally can include treatment with IFN-α monotherapy or IFN-α combination therapy, where the combination therapy may include administration of IFN-α and an antiviral agent such as ribavirin.

The term "dosing event" as used herein refers to administration of an antiviral agent to a patient in need thereof, which event may encompass one or more releases of an antiviral agent from a drug dispensing device. Thus, the term "dosing event," as used herein, includes, but is not limited to, installation of a continuous delivery device (e.g., a pump or other controlled release injectable system); and a single subcutaneous injection followed by installation of a continuous delivery system.

"Patterned" or "temporal" as used in the context of drug delivery is meant delivery of drug in a pattern, generally a substantially regular pattern, over a pre-selected period of time (e.g., other than a period associated with, for example a bolus injection). "Patterned" or "temporal" drug delivery is meant to encompass delivery of drug at an increasing, decreasing, substantially constant, or pulsatile, rate or range of rates (e.g., amount of drug per unit time, or volume of drug formulation for a unit time), and further encompasses delivery that is continuous or substantially continuous, or chronic.

The term "controlled drug delivery device" is meant to encompass any device wherein the release (e.g., rate, timing of release) of a drug or other desired substance contained therein is controlled by or determined by the device itself and not substantially influenced by the environment of use, or releasing at a rate that is reproducible within the environment of use.

By "substantially continuous" as used in, for example, the context of "substantially continuous infusion" or "substantially continuous delivery" is meant to refer to delivery of drug in a manner that is substantially uninterrupted for a pre-selected period of drug delivery, where the quantity of drug received by the patient during any 8 hour interval in the pre-selected period never falls to zero. Furthermore, "substantially continuous" drug delivery can also encompass delivery of drug at a substantially constant, pre-selected rate or range of rates (e.g., amount of drug per unit time, or volume of drug formulation for a unit time) that is substantially uninterrupted for a pre-selected period of drug delivery.

As used herein, the term "pirfenidone" refers to 5-methyl-1-phenyl-2-(1H)-pyridone. As used herein, the term "pirfenidone analog" refers to any compound of Formula I, IIA, or IIB, below. A "specific pirfenidone analog," and all grammatical variants thereof, refers to, and is limited to, each and every pirfenidone analog shown in Table 10.

The term "anti-fibrotic" agent, drug or compound is meant to encompass agents that prevent or reduce fibrosis, including: Type II interferon receptor agonists (e.g. interferon-gamma); pirfenidone and pirfenidone analogs; anti-angiogenic agents, such as VEGF antagonists, VEGF receptor antagonists, bFGF antagonists, bFGF receptor antagonists, TGF-beta antagonists, and TGF-beta receptor antagonists; and anti-inflammatory agents, including tumor necrosis factor (TNF) antagonists, such as anti-TNF antibodies (e.g. REMICADE™ anti-TNF monoclonal antibody) and soluble TNF receptor (e.g. ENBREL™ TNF receptor-Ig immunoadhesin), and IL-1 antagonists, such as IL-1Ra.

The terms "angiogenic agent," "angiogenic compound," and "angiogenic factor" are meant to include agents that promote neovascularization, such as VEGF, bFGF, and TGF-beta.

The terms "anti-angiogenic" or "angiostatic" agent, drug or compound, or "angiogenesis inhibitor," are meant to include agents that prevent or reduce neovascularization, such as VEGF antagonists, VEGF receptor antagonists, bFGF antagonists, bFGF receptor antagonists, TGF-beta antagonists, and TGF-beta receptor antagonists.

As used herein, the term "nucleoside" refers to a compound composed of any pentose or modified pentose moiety attached to a specific position of a heterocycle or to the natural position of a purine (9-position) or pyrimidine (1-position) or to the equivalent position in an analog.

As used herein, the term "nucleotide" refers to a phosphate ester substituted on the 5'-position of a nucleoside.

As used herein, the term "heterocycle" refers to a monovalent saturated or unsaturated carbocyclic radical having at least one hetero atom, such as N, O, S, Se or P, within the ring, each available position of which can be optionally substituted, independently, with, e.g., hydroxyl, oxo, amino, imino, lower alkyl, bromo, chloro and/or cyano. Included within the term "heterocycle" are purines and pyrimidines.

As used herein, the term "purine" refers to nitrogenous bicyclic heterocycles.

As used herein, the term "pyrimidine" refers to nitrogenous monocyclic heterocycles.

As used herein, the term "L-nucleoside" refers to a nucleoside compound that has an L-ribose sugar moiety.

The term "antineoplastic" agent, drug or compound is meant to refer to any agent, including any chemotherapeutic agent, biological response modifier (including without limitation (i) proteinaceous, i.e. peptidic, molecules capable of elaborating or altering biological responses and (ii) non-proteinaceous, i.e. non-peptidic, molecules capable of elaborating or altering biological responses), cytotoxic agent, or cytostatic agent, that reduces proliferation of a neoplastic cell.

The term "anti-fibrotic" agent, drug or compound is meant to encompass agents that prevent or reduce fibrosis, including: Type II interferon receptor agonists (e.g. interferon-gamma); pirfenidone and pirfenidone analogs; anti-angiogenic agents, such as VEGF antagonists, VEGF receptor antagonists, bFGF antagonists, bFGF receptor antagonists, TGF-beta antagonists, and TGF-beta receptor antagonists; and anti-inflammatory agents, including tumor necrosis factor (TNF) antagonists, such as anti-TNF antibodies (e.g. REMICADE™ anti-TNF monoclonal antibody) and soluble TNF receptor (e.g. ENBREL™ TNF receptor-Ig immunoadhesin), and IL-1 antagonists, such as IL-1Ra.

The term "chemotherapeutic agent" or "chemotherapeutic" (or "chemotherapy", in the case of treatment with a chemotherapeutic agent) is meant to encompass any non-proteinaceous (i.e., non-peptidic) chemical compound useful in the treatment of cancer. Examples of chemotherapeutic agents include alkylating agents such as thiotepa and cyclophosphamide (CYTOXAN™); alkyl sulfonates such as busulfan, improsulfan and piposulfan; aziridines such as berizodopa, carboquone, meturedopa, and uredopa; ethylenimines and methylamelamines including altretamine, triethylenemelamine, triethylenephosphoramide, triethylenethiophosphoramide and trimethylolomelamine; acetogenins (especially bullatacin and bullatacinone); a camptothecin (including synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CBI-TMI); eleutherobin; pancratistatin; a sarcodictyin; spongistatin; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, foremustine, lomustine, nimustine, ranimustine; antibiotics such as the enediyne antibiotics (e.g. calicheamicin, especially calicheamicin gamma1I and calicheamicin phiI1, see, e.g., Agnew, Chem. Intl. Ed. Engl., 33: 183-186 (11024); dynemicin, including dynemicin A; bisphosphonates, such as clodronate; an esperamicin; as well as neocarzinostatin chromophore and related chromoprotein enediyne antibiotic chromomophores), aclacinomysins, actinomycin, authramycin, azaserine, bleomycins, cactinomycin, carabicin, carminomycin, carzinophilin, chromomycins, dactinomycin, daunorubicin, detorubicin, 6-diazo-5-oxo-L-norleucine, doxorubincin (Adramycin™) (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as demopterin, methotrexate, pteropterin, trimetrexate; purine analogs such as fludarabine, 6-mercaptopurine, thiamiprine, thioguanine; pyrimidine analogues such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfomithine; elliptinium acetate; an epothilone; etoglucid; gallium nitrate; hydroxyurea; lentinan; lonidamine; maytansinoids such as maytansine and ansamitocins; mitoguazone; mitoxantrone; mopidamol; nitracrine; pentostatin; phenamet; pirarubicin; losoxantrone; podophyllinic acid; 2-ethylhydrazide; procarbazine; PSK®; razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethane; vindesine; dacarbazine; mannomustine; mitobronitol; mitolactol; pipobroman; gacytosine; arabinoside ("Ara-C"); cyclophosphamide; thiopeta; taxoids, e.g. paclitaxel (TAXOL®, Bristol Meyers Squibb Oncology, Princeton, N.J.) and docetaxel (TAXOTERE®, Rhone-Poulenc Rorer, Antony, France); chlorambucil; gemcitabine (Gemzar™); 6-thioguanine; mercaptopurine; methotrexate; platinum analogs such as cisplatin and carboplatin; vinblastine; platinum; etoposide (VP-16); ifosfamide; mitroxantrone; vancristine; vinorelbine (Navelbine™); novantrone; teniposide; edatrexate; daunomycin; aminopterin; xeoloda; ibandronate; CPT-11; topoisomerase inhibitor RFS 2000; difluromethylomithine (DMFO); retinoids such as retinoic acid; capecitabine; and pharmaceutically acceptable salts, acids or derivatives of any of the above. Also included in the definition of "chemotherapeutic agent" are anti-hormonal agents that act to regulate or inhibit hormone action on tumors such as anti-estrogens and selective estrogen receptor modulators (SERMs), including, for example, tamoxifen (including Nolvadex™), raloxifene, droloxifene, 4-hydroxytamoxifen, trioxifene, keoxifene, LY117018, onapristone, and toremifene (Fareston™); inhibitors of the enzyme aromatase, which regulates estrogen production in the adrenal glands, such as, for example, 4(5)-imidazoles, aminoglutethimide, megestrol acetate (Megace™), exemestane, formestane, fadrozole, vorozole (Rivisor™), letrozole (Femara™), and anastrozole (Arimidex™); and anti-androgens such as flutamide, nilutamide, bicalutamide, leuprolide, and goserelin; and pharmaceutically acceptable salts, acids or derivatives of any of the above.

The term "antineoplastic" agent, drug or compound is meant to refer to any agent, including any chemotherapeutic agent, biological response modifier (including without limitation (i) proteinaceous, i.e. peptidic, molecules capable of elaborating or altering biological responses and (ii) non-proteinaceous, i.e. non-peptidic, molecules capable of elaborating or altering biological responses), cytotoxic agent, or cytostatic agent, that reduces proliferation of a neoplastic cell.

The term "biological response modifier" refers to any proteinaceous (i.e., peptidic) molecule or any non-proteinaceous (i.e., non-peptidic) molecule capable of elaborating or altering a biological response relevant to the treatment of cancer. Examples of biological response modifiers include antagonists of tumor-associated antigens, such as anti-tumor antigen antibodies, antagonists of cellular receptors capable of inducing cell proliferation, agonists of cellular receptors capable of inducing apoptosis, such as Apo-2 ligands, Type I interferon receptor agonists, such as interferon-α molecules and interferon-β molecules, Type II interferon receptor agonists, such as interferon-γ molecules, Type III interferon receptor agonists, such as IL-28A, IL-28B, and IL-29, antagonists of inflammatory cytokines, including tumor necrosis factor (TNF) antagonists, such as anti-TNF antibodies (e.g. REMICADE™ anti-TNF monoclonal antibody) and soluble TNF receptor (e.g. ENBREL™ TNF receptor-Ig immunoadhesin), growth factor cytokines, such as hematopoietic cytokines, including erythropoietins, such as EPOGEN™ epoetin-alfa, granulocyte colony stimulating factors (G-CSFs), such as NEUPOGEN™ filgrastim, granulocyte-macrophage colony stimulating factors (GM-CSFs), and thrombopoietins, lymphocyte growth factor cytokines, such as interleukin-2, and antagonists of growth factor cytokines, including antagonists of angiogenic factors, e.g. vascular endothelial cell growth factor (VEGF) antagonists, such as AVASTIN™ bevacizumab (anti-VEGF monoclonal antibody).

As used herein, the term "HCV enzyme inhibitor" refers to any agent that inhibits an enzymatic activity of an enzyme encoded by HCV. The term "HCV enzyme inhibitor" includes, but is not limited to, agents that inhibit HCV NS3 protease activity; agents that inhibit HCV NS3 helicase activity; and agents that inhibit HCV NS5B RNA-dependent RNA polymerase activity.

As used herein, the terms "HCV NS3 protease inhibitor" and "NS3 protease inhibitor" refer to any agent that inhibits the protease activity of HCV NS3/NS4A complex. Unless otherwise specifically stated, the term "NS3 inhibitor" is used interchangeably with the terms "HCV NS3 protease inhibitor" and "NS3 protease inhibitor."

As used herein, the terms "HCV NS5B inhibitor," "NS5B inhibitor," "HCV NS5B RNA-dependent RNA polymerase inhibitor," "HCV RDRP inhibitor," and "RDRP inhibitor," refer to any agent that inhibits HCV NS5B RNA-dependent RNA polymerase activity.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods or materials in connection with which the publications are cited.

It must be noted that as used herein and in the appended claims, the singular forms "a", "and", and "the" include plural referents unless the context clearly dictates otherwise. Thus, for example, reference to "a protease-resistant or protease-resistant, hyperglycosylated polypeptide variant" includes a plurality of such polypeptide variants and reference to "the oral formulation" includes reference to one or more oral formulations and equivalents thereof known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION OF THE INVENTION

The present invention provides oral pharmaceutical compositions comprising a hyperglycosylated or protease-resistant, hyperglycosylated polypeptide variant of a parent protein therapeutic. The hyperglycosylated or protease-resistant, hyperglycosylated polypeptide variant contains (1) a carbohydrate moiety covalently linked to at least one non-native glycosylation site not found in the parent protein therapeutic or (2) a carbohydrate moiety covalently linked to at least one native glycosylation site found but not glycosylated in the parent protein therapeutic. In addition, the known protease-resistant, hyperglycosylated polypeptide variant comprises at least one mutated protease cleavage site in place of a native protease cleavage site found in the parent protein therapeutic, and thus exhibits increased protease resistance compared to the parent protein therapeutic.

The present invention further provides therapeutic methods for treating a disease in a patient involving orally administering to the patient a known hyperglycosylated or protease-resistant, hyperglycosylated polypeptide variant in an oral dosage form and at a dosing interval that delivers more drug (on a mole basis) per dose and at least as many doses per unit of time as that received by the patient in a method proven to be effective for treating the disease by subcutaneous bolus injection of the parent polypeptide in a parenteral dosage form.

The present invention further provides synthetic Type I interferon receptor polypeptide agonists that contain one or more glycosylation sites; and compositions, including pharmaceutical compositions, comprising the agonists. The present invention further provides nucleic acids comprising nucleotide sequences encoding subject polypeptide agonists; and host cells comprising subject nucleic acids. The present invention further provides containers and kits comprising a subject polypeptide agonist.

A subject synthetic Type I interferon receptor polypeptide agonist comprises a hybrid or consensus Type I interferon receptor polypeptide agonist comprising at least one glycosylation site. The glycosylation site(s) provides a site for attachment of a carbohydrate moiety on the subject synthetic polypeptide agonist, such that when the subject synthetic polypeptide agonist is produced in a eukaryotic cell capable of glycosylation, the subject synthetic polypeptide agonist is glycosylated. The glycosylation confers one or more advantages on the subject synthetic polypeptide agonist, relative to a parent Type I interferon receptor polypeptide agonist, or compared to a naturally-occurring Type I interferon receptor polypeptide agonist. Such advantages include increased serum half-life; reduced immunogenicity; increased functional in vivo half-life; reduced degradation by gastrointestinal tract conditions; and increased rate of absorption by gut epithelial cells. An increased rate of absorption by gut epithelial cells and reduced degradation by gastrointestinal tract conditions is important for enteral (e.g., oral) formulations of a subject synthetic Type I interferon receptor polypeptide agonist.

Subject synthetic Type I interferon receptor polypeptide agonists are useful for treating various disorders, including viral infections, fibrotic disorders, and proliferative disorders. Accordingly, the present invention further provides methods of treating viral infections, methods of treating fibrotic disorders, and methods of treating proliferative disorders, the methods generally involving administering to an individual in need thereof an effective amount of a subject synthetic polypeptide agonist. In some embodiments, a subject treatment method further involves administration of at least one additional therapeutic agent to treat the viral infection, fibrotic disorder, or proliferative disorder. In some embodiments, a subject treatment method further involves administering at least one side effect management agent to reduce side effects induced by one or more of the therapeutic agents.

In another aspect, the synthetic Type I interferon receptor polypeptide agonists of the invention find utility as reagents for detection and isolation of Type I interferon receptor, such as detection of Type I interferon receptor expression in various cell types and tissues, including the determination of Type I interferon receptor density and distribution in cell populations, and cell sorting based on Type I interferon receptor expression. In yet another aspect, the subject synthetic Type I interferon receptor agonists are useful for the development of agents with Type I interferon receptor binding or activation patterns similar to those of the subject synthetic Type I interferon receptor agonists. The synthetic Type I interferon receptor agonists of the invention can be used in Type I interferon receptor signal transduction assays to screen for small molecule agonists or antagonists of Type I interferon receptor signaling.

Polypeptide Variants

The present invention relates to hyperglycosylated or protease-resistant; hyperglycosylated polypeptide variants. The hyperglycosylated or protease-resistant, hyperglycosylated polypeptide variants comprise at least one mutated protease cleavage site in place of a native protease cleavage site found in the parent protein therapeutic, and thus exhibit increased protease resistance compared to the parent protein therapeutic.

A protease cleavage site that is found in a parent protein therapeutic, and that is mutated in a hyperglycosylated or protease-resistant, hyperglycosylated polypeptide variant, such that the site is no longer cleaved, or exhibits greater resistance to cleavage (i.e., is a worse substrate than the native site for proteolytic processing) by the protease that cleaves the protease cleavage site in the parent protein, is referred to herein as a "mutated protease cleavage site" or a "mutant cleavage site." A protease cleavage site that is found in a parent protein therapeutic is referred to herein as a "native protease cleavage site."

In addition, a hyperglycosylated or protease-resistant, hyperglycosylated polypeptide variant includes (1) a carbohydrate moiety covalently attached to at least one non-native glycosylation site not found in a parent protein therapeutic or (2) a carbohydrate moiety covalently attached to at least one native glycosylation site found but not glycosylated in a parent protein therapeutic. A glycosylation site that is not found in a parent protein therapeutic is referred to herein as a "non-native glycosylation site." A glycosylation site that is found in but not glycosylated in a parent protein therapeutic is referred to herein as a "native glycosylation site." Thus, a hyperglycosylated or protease-resistant, hyperglycosylated polypeptide variant includes (1) a carbohydrate moiety covalently linked to the at least one non-native glycosylation site and/or (2) a carbohydrate moiety covalently linked to the at least one native glycosylation site. A hyperglycosylated or protease-resistant, hyperglycosylated polypeptide variant that includes (1) a carbohydrate moiety covalently linked to a non-native glycosylation site or (2) a carbohydrate moiety covalently linked to a native glycosylation site, and that comprises at least one mutated protease cleavage site in place of a native protease cleavage site found in a parent protein therapeutic, is referred to herein as a "hyperglycosylated or protease-resistant, hyperglycosylated polypeptide variant."

A "known" hyperglycosylated or protease-resistant, hyperglycosylated polypeptide variant means any hyperglycosylated or protease-resistant, hyperglycosylated polypeptide variant presently in existence or hereafter created that (1) retains a desired pharmacologic activity of a parent protein therapeutic and (2) exhibits a longer serum half-life or greater area under the curve of drug concentration in serum as a function of time (AUC) compared to that exhibited by the parent protein therapeutic when administered to a patient in a similar form and at a similar dose, dosing frequency and route of administration. The present invention provides compositions, including oral pharmaceutical compositions, comprising the known hyperglycosylated or protease-resistant, hyperglycosylated polypeptide variants.

A known hyperglycosylated, hyperglycosylated polypeptide variant is provided in a formulation suitable for oral delivery. The parent protein therapeutic is ordinarily administered in an immediate release formulation suitable for subcutaneous bolus injection. Typically, the oral dosage form of the known hyperglycosylated or protease-resistant, hyperglycosylated polypeptide variant contains a first number of moles; and the parent protein therapeutic is in a parenteral dosage form that contains a second number of moles. In general, the first number of moles is greater than the second number of moles. Nevertheless, a hyperglycosylated or protease-resistant, hyperglycosylated polypeptide variant in the oral dosage form is released over a period of time that is no longer than the dosing interval used in the administration of the parent protein therapeutic in a regimen proven to be effective for the treatment of a disease in a patient.

The parent protein therapeutic is typically in a parenteral dosage form administered by subcutaneous bolus injection, which provides a "depot" effect, slowly releasing the protein therapeutic into the bloodstream by diffusion of drug away from the tissues surrounding the injection site.

A subject method of the invention replaces the subcutaneous bolus injection "depot" effect with a comparable pharmacokinetic profile achieved by oral delivery of a longer-acting agent (a known hyperglycosylated, protease-resistant polypeptide variant with a greater serum half-life and/or AUC than its parent protein) free of an extended release or depot formulation. That is, the time required for release of the first number of moles of the known hyperglycosylated, protease-resistant polypeptide variant, when administered orally, is no greater than the period of time between doses of the parent protein therapeutic when administered by subcutaneous bolus injection in a method that is proven to be effective for treatment of the disease. Thus, in some embodiments, a known hyperglycosylated, protease-resistant polypeptide variant is administered at least as frequently, or in many cases more frequently, and at higher dosage (on a mole basis) than the parent protein therapeutic.

Structural Features

A hyperglycosylated or protease-resistant, hyperglycosylated polypeptide variant has an amino acid sequence that comprises one or more mutated protease cleavage sites in place of a native protease cleavage site(s) found in a corresponding parent protein therapeutic; and has an amino acid sequence that comprises (1) one or more non-native glycosylation sites and/or (2) one or more native glycosylation sites. Thus, e.g., a desired polypeptide variant has an amino acid sequence that comprises one or more mutated protease cleavage sites in place of a native protease cleavage site(s) found in a parent protein therapeutic; and has an amino acid sequence that comprises one or more glycosylation sites not found in the parent protein therapeutic or found but not glycosylated in the parent protein therapeutic. A parent protein therapeutic is in some embodiments a corresponding naturally-occurring polypeptide. In other embodiments, a parent protein therapeutic is a non-naturally occurring polypeptide (e.g., a synthetic polypeptide, a hybrid polypeptide, a consensus polypeptide, a fusion polypeptide, a recombinant polypeptide, or other variant of a naturally-occurring polypeptide). As used herein, the terms "polypeptide variant" and "variant polypeptide" both refer to any polypeptide that comprises one or more mutated protease cleavage sites in place of a native protease cleavage sites(s) found in a parent protein therapeutic; and that comprises (1) one or more glycosylation sites not found in the parent protein therapeutic or (2) one or more glycosylation sites found but not glycosylated in the parent protein therapeutic.

Non-native and native glycosylation sites include N-linked glycosylation sites, and O-linked glycosylation sites. N-linked glycosylation sites include, e.g., Asn-X-Ser/Thr, where the asparagine residue provides a site for N-linked glycosylation, and where X is any amino acid. O-linked glycosylation sites include at least one serine or threonine residue. A number of O-linked glycosylation sites are known in the art and have been reported in the literature. See, e.g., Ten Hagen et al. (11029) *J. Biol. Chem.* 274(39):27867-74; Hanisch et al. (2001) *Glycobiology* 11:731-740; and Ten Hagen et al. (2003) *Glycobiology* 13:1R-16R.

In all embodiments, a polypeptide variant is hyperglycosylated, e.g., a polypeptide variant comprises (1) a carbohydrate moiety covalently linked to a non-native glycosylation site and/or (2) a carbohydrate moiety covalently linked to a native glycoyslation site. In many embodiments, a known hyperglycosylated or protease-resistant, hyperglycosylated polypeptide variant comprises a carbohydrate moiety covalently linked to a native glycosylation site; and a carbohydrate moiety covalently linked to a non-native glycosylation site. In some embodiments, a known hyperglycosylated or protease-resistant, hyperglycosylated polypeptide variant comprises O-linked glycosylation. In other embodiments, a known hyperglycosylated or protease-resistant, hyperglycosylated polypeptide variant comprises N-linked glycosylation. In other embodiments, a known hyperglycosylated or protease-resistant, hyperglycosylated polypeptide variant comprises both O-linked and N-linked glycosylation.

In some embodiments, a known hyperglycosylated or protease-resistant, hyperglycosylated polypeptide variant comprises one, two, three, four, or five carbohydrate moieties, each linked to different glycosylation sites. In some embodiments, a known hyperglycosylated or protease-resistant, hyperglycosylated polypeptide variant is glycosylated at a non-native glycosylation site. In some of these embodiments, a known hyperglycosylated or protease-resistant, hypergycosylated polypeptide variant is glycosylated at a single non-native glycosylation site. In other embodiments, a known hyperglycosylated or protease-resistant, hyperglycosylated polypeptide variant is glycosylated at more than one non-native glycosylation site, e.g., the known hyperglycosylated or protease-resistant, hyperglycosylated polypeptide variant is glycosylated at two, three, or four non-native glycosylation sites.

In other embodiments, a known hyperglycosylated or protease-resistant, hyperglycosylated polypeptide variant is glycosylated at a native glycosylation site. In some of these embodiments, a known hyperglycosylated or protease-resistant, hyperglycosylated polypeptide variant is glycosylated at a single native glycosylation site. In other embodiments, a known hyperglycosylated or protease-resistant, hyperglycosylated polypeptide variant is glycosylated at more than one native glycosylation site, e.g., the known hyperglycosylated or protease-resistant, hyperglycosylated polypeptide variant is glycosylated at two, three, or four native glycosylation sites.

In other embodiments, a known hyperglycosylated or protease-resistant, hyperglycosylated polypeptide variant is glycosylated at both a native glycosylation site(s) and a non-native glycosylation site(s).

A known hyperglycosylated or protease-resistant, hyperglycosylated polypeptide variant can comprise at least one additional carbohydrate moiety not found in a parent protein therapeutic when each is synthesized in a eukaryotic cell that is capable of N- and/or O-linked protein glycosylation. Thus, e.g., compared to a parent protein therapeutic, a known hyperglycosylated or protease-resistant, hyperglycosylated polypeptide variant can comprise at least one, at least two, at least three, or at least four, or more, additional carbohydrate moieties. For example, where a parent protein therapeutic has one covalently linked carbohydrate moiety, a known hyperglycosylated or protease-resistant, hyperglycosylated polypeptide variant can have two, three, four, or more, covalently linked carbohydrate moieties. In some embodiments, the known hyperglycosylated or protease-resistant, hyperglycosylated polypeptide variant lacks a carbohydrate moiety covalently linked to a non-native glycosylation site; and has instead at least one, at least two, at least three, or at least four, or more, additional carbohydrate moieties attached to native glycosylation sites. In other embodiments, the known hyperglycosylated or protease-resistant, hyperglycosylated polypeptide variant lacks a carbohydrate moiety covalently linked to a native glycosylation site; and has instead at least two, at least three, or at least four, or more, carbohydrate moieties attached to non-native glycosylation sites.

Glycosylated Type I Interferons

A subject synthetic Type I interferon receptor polypeptide agonist can have a consensus or hybrid Type I interferon receptor polypeptide agonist amino acid sequence that comprises one or more non-native glycosylation sites. Thus, e.g., a subject synthetic Type I interferon receptor polypeptide agonist can have an amino acid sequence that comprises one or more glycosylation sites not found in a naturally-occurring Type I interferon receptor polypeptide agonist, e.g., not found in any known naturally occurring IFN-α, IFN-β, IFN-κ, IFN-τ, or IFN-ω. As used herein, the term "non-native glycosylation site" is defined as a glycosylation site located at a position in a synthetic Type I interferon receptor polypeptide agonist amino acid sequence, for which glycosylation site/position there is no homologous glycosylation site/position that exists in a naturally-occurring Type I interferon receptor polypeptide agonist amino acid sequence.

Alternatively, a subject synthetic Type I interferon receptor polypeptide agonist can have a consensus or hybrid Type I interferon receptor polypeptide agonist amino acid sequence that comprises one or more naturally-occurring or native glycosylation sites. As used herein, the term "native glycosylation site" is defined as a glycosylation site located at a position in a synthetic Type I interferon receptor polypeptide agonist amino acid sequence, for which glycosylation site/position there is a homologous glycosylation site/position that exists in at least one naturally-occurring Type I interferon receptor polypeptide agonist amino acid sequence.

As used herein, the term "synthetic Type I interferon receptor polypeptide agonist" is defined as any consensus or hybrid Type I interferon polypeptide agonist that comprises one or more glycosylation sites. Thus, a "synthetic Type I interferon receptor polypeptide agonist" encompasses any hybrid or consensus Type I interferon receptor polypeptide agonist that comprises one or more glycosylation sites, including any hybrid or consensus Type I interferon receptor polypeptide agonist that comprises one or more native glycosylation sites and/or one or more non-native glycosylation sites.

A "parent Type I interferon receptor polypeptide agonist" is a Type I interferon receptor polypeptide agonist that serves as a reference point for comparison. In some embodiments, a subject synthetic Type I interferon receptor polypeptide agonist comprises at least one additional glycosylation site not found in a parent Type I interferon receptor polypeptide agonist. For example, in some embodiments, a parent Type I interferon receptor polypeptide agonist is Infergen® consensus IFN-α (InterMune, Inc., Brisbane, Calif.). As shown in FIG. 25, a subject synthetic Type I interferon receptor polypeptide agonist comprises one or more glycosylation sites not found in the parent Infergen® consensus IFN-α.

A subject synthetic Type I interferon receptor polypeptide agonist has a length of from about 150 amino acids to about 200 amino acids, e.g., from about 150 amino acids to about 155 amino acids, from about 155 amino acids to about 160 amino acids, from about 160 amino acids to about 165 amino acids, from about 165 amino acids to about 170 amino acids, from about 170 amino acids to about 175 amino acids, from about 175 amino acids to about 180 amino acids, from about 180 amino acids to about 185 amino acids, from about 185 amino acids to about 190 amino acids, from about 190 amino acids to about 195 amino acids, or from about 195 amino acids to about 200 amino acids.

In some embodiments, the amino acid sequence of a naturally-occurring Type I interferon receptor polypeptide agonist is modified to include at least one non-native glycosylation site. As one non-limiting example, where a naturally occurring Type I interferon receptor polypeptide agonist comprises the amino acid sequence KDSS, the KDSS sequence is modified to KNSS. As another non-limiting example, where a naturally occurring Type I interferon receptor polypeptide agonist comprises the amino acid sequence WDET, the WDET sequence is modified to WNET. As another non-limiting example, where a naturally occurring Type I interferon receptor polypeptide agonist comprises the amino acid sequence VEET, the VEET sequence is modified to VTET. As another non-limiting example, where a naturally occurring Type I interferon receptor polypeptide agonist comprises the amino acid sequence VEET, the VEET sequence is modified to VNET.

In many embodiments, a subject synthetic Type I interferon receptor polypeptide agonist is glycosylated. In some embodiments, a subject synthetic Type I interferon receptor polypeptide agonist comprises O-linked glycosylation. In other embodiments, a subject synthetic Type I interferon receptor polypeptide agonist comprises N-linked glycosylation. In other embodiments, a subject synthetic Type I interferon receptor polypeptide agonist comprises both O-linked and N-linked glycosylation.

In some embodiments, a subject synthetic Type I interferon receptor polypeptide agonist is glycosylated at a non-native glycosylation site. In some of these embodiments, a subject synthetic Type I interferon receptor polypeptide agonist is glycosylated at a single non-native glycosylation site. In other embodiments, a subject synthetic Type I interferon receptor polypeptide agonist is glycosylated at more than one non-native glycosylation site, e.g., the subject synthetic Type I interferon receptor polypeptide agonist is glycosylated at two, three, or four non-native glycosylation sites.

In other embodiments, a subject synthetic Type I interferon receptor polypeptide agonist is glycosylated at a native glycosylation site. In some of these embodiments, a subject synthetic Type I interferon receptor polypeptide agonist is glycosylated at a single native glycosylation site. In other embodiments, a subject synthetic Type I interferon receptor polypeptide agonist is glycosylated at more than one native glycosylation site, e.g., the subject synthetic Type I interferon receptor polypeptide agonist is glycosylated at two, three, or four native glycosylation sites.

In other embodiments, a subject synthetic Type I interferon receptor polypeptide agonist is glycosylated at both a native glycosylation site(s) and a non-native glycosylation site(s).

Whether a subject synthetic Type I interferon receptor polypeptide agonist comprises N-linked and/or O-linked glycosylation is readily determined using standard techniques. See, e.g., "Techniques in Glycobiology" R. Townsend and A. Hotchkiss, eds. (11027) Marcel Dekker; and "Glycoanalysis Protocols (Methods in Molecular Biology, Vol. 76)" E. Hounsell, ed. (11028) Humana Press. The change in electrophoretic mobility of a protein before and after treatment with chemical or enzymatic deglycosylation (e.g., using endoglycosidases and/or exoglycosidases) is routinely used to determine the glycosylation status of a protein. Enzymatic deglycosylation can be carried out using any of a variety of enzymes, including, but not limited to, peptide-N-4-(N-acetyl-β-D-glucosaminyl) asparagine amidase (PNGase F); endoglycosidase F1, endoglycosidase F2, endoglycosidase F3, α(2→3,6,8,9) neuraminidase, and the like. For example, sodium docecyl sulfate-polyacrylamide gel electrophoresis (SDS-PAGE) analysis of the protein, either pre-treated with PNGase F or untreated with PNGaseF, is conducted. A marked decrease in band width and change in migration position after treatment with PNGaseF is considered diagnostic of N-linked glycosylation. The carbohydrate content of a glycosylated protein can also be detected using lectin analysis of protein blots (e.g., proteins separated by SDS-PAGE and transferred to a support, such as a nylon membrane). Lectins, carbohydrate-binding proteins from various plant tissues, have both high affinity and narrow specificity for a wide range of defined sugar epitopes found on glycoprotein glycans. Cummings (11024) Methods in Enzymol. 230:66-86. Lectins can be detectably labeled (either directly or indirectly), allowing detection of binding of lectins to carbohydrates on glycosylated proteins. For example, when conjugated with biotin or digoxigenin, a lectin bound to a glycosylated protein can be easily identified on membrane blots through a reaction utilizing avidin or anti-digoxigenin antibodies conjugated with an enzyme such as alkaline phosphatase, β-galactosidase, luciferase, or horse radish peroxidase, to yield a detectable product. Screening with a panel of lectins with well-defined specificity provides considerable information about a glycoprotein's carbohydrate complement.

Consensus Type I Interferon Receptor Polypeptide Agonists with Non-native Glycosylation Site(s)

In some embodiments, a subject synthetic Type I interferon receptor polypeptide agonist comprises a consensus amino acid sequence and at least one non-native glycosylation site. In other embodiments, a subject synthetic Type I interferon receptor polypeptide agonist comprises a consensus amino acid sequence and at least one native glycosylation site.

A consensus sequence is derived by aligning three or more amino acid sequences, and identifying amino acids that are shared by at least two of the sequences. In some embodiments, a synthetic Type I interferon receptor polypeptide agonist comprises a consensus sequence derived from determining a consensus sequence of naturally occurring human IFN-α2b, naturally-occurring human IFN-α14, and naturally-occurring human IFN-β1. In other embodiments, a synthetic Type I interferon receptor polypeptide agonist comprises a consensus sequence derived from determining a consensus sequence of naturally occurring human IFN-α2b, naturally-occurring human IFN-α14, and naturally-occurring human IFN-ω1. In other embodiments, a synthetic Type I interferon receptor polypeptide agonist comprises a consensus sequence derived from determining a consensus sequence of naturally occurring human IFN-α2b, naturally-occurring human IFN-β1, and naturally-occurring human IFN-ω1. In other embodiments, a synthetic Type I interferon receptor polypeptide agonist comprises a consensus sequence derived from determining a consensus sequence of naturally occurring human IFN-α14, naturally-occurring human IFN-β1, and naturally-occurring human IFN-ω1. In other embodiments, a synthetic Type I interferon receptor polypeptide agonist comprises a consensus sequence derived from determining a consensus sequence of naturally occurring human IFN-α2b, naturally-occurring human IFN-α14, naturally-occurring human IFN-β1, and naturally-occurring human IFN-ω1. In other embodiments, the comparison further comprises including in the comparison the amino acid sequence of Infergen® consensus IFN-α.

In some of these embodiments, the subject synthetic Type I interferon receptor polypeptide agonist is a consensus sequence containing one or more glycosylation sites originating from one or more of the parent Type I interferon receptor polypeptide agonist amino acid sequences used to derive the consensus sequence. In additional embodiments, the consensus sequence is further modified to incorporate at least one non-native glycosylation site.

Figure 24:
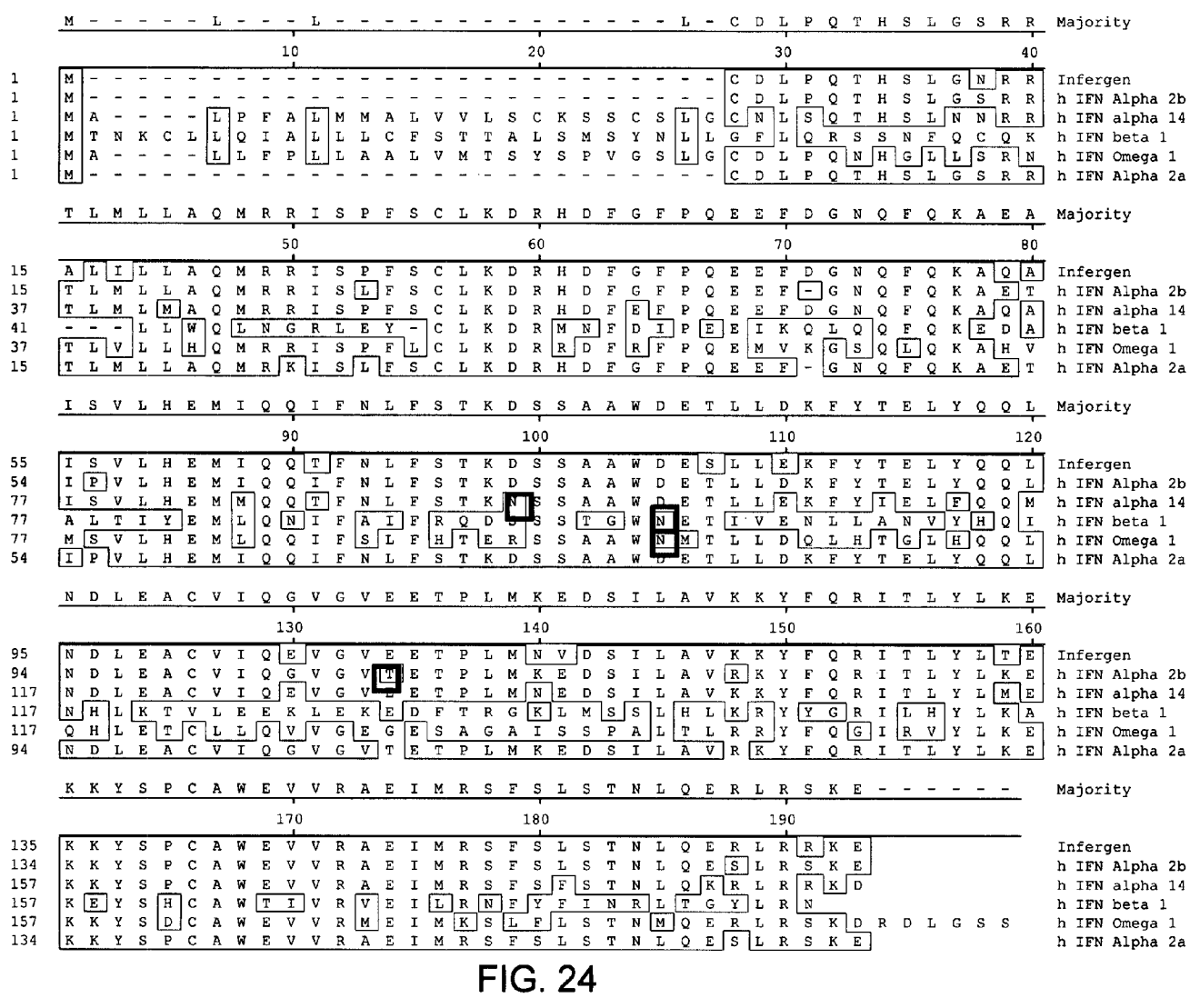

In one embodiment, the subject synthetic Type I interferon receptor polypeptide agonist comprises an amino acid sequence corresponding to the majority sequence depicted in FIG. 24 (SEQ ID NO:1355), further modified to incorporate at least one non-native glycosylation site.

In another embodiment, the subject synthetic Type I interferon receptor polypeptide agonist comprises an amino acid sequence corresponding to the majority sequence depicted in FIG. 24 (SEQ ID NO:1355), further modified to incorporate at least one glycosylation site from the group of the VTET glycosylation site of IFN-α2b, the KNSS glycosylation site of IFN-α14, the WNET glycosylation site of IFN-β1, and the WNMT glycosylation site of IFN-ω1. In other embodiments, the majority sequence is additionally modified to incorporate one or more non-native glycosylation sites.

In other embodiments, a subject synthetic Type I interferon receptor polypeptide agonist is obtained from a consensus sequence that does not have a glycosylation site originating from a parent Type I interferon receptor polypeptide agonist. In these embodiments, the consensus sequence is then further modified to include at least one non-native glycosylation site in order to obtain the subject synthetic Type I interferon receptor polypeptide agonist. For example, in some embodiments, where the consensus sequence includes KDSS, the KDSS sequence is modified to KNSS or KNST. As another non-limiting example, where the consensus sequence includes WDET, the WDET sequence is modified to WNET or WNES. As another non-limiting example, where the consensus sequence includes VEET, the VEET sequence is modified to VTET, VNES or VNET.

In particular embodiments, a subject synthetic Type I interferon receptor polypeptide agonist comprises the amino acid sequence identified as "majority" in FIG. 24, and further comprises one or more of the following modifications: KDSS modified to KNST; WDET modified to WNES; VEET modified to VNES or VNET.

In some particular embodiments, a subject synthetic Type I interferon receptor polypeptide agonist comprises an amino acid sequence as set forth in any one of SEQ ID NOs:1363-1373, as set forth in FIG. 25.

In one embodiment, a subject synthetic Type I interferon receptor polypeptide agonist comprises an amino acid sequence corresponding to the majority sequence depicted in FIG. 28 (SEQ ID NO:1390), further modified to incorporate at least one non-native glycosylation site. In some embodiments, a subject Type I interferon receptor polypeptide agonist comprises an amino acid sequence as set forth in any one of SEQ ID NOs:1392-1396, as set forth in FIG. 28.

In one embodiment, a subject synthetic Type I interferon receptor polypeptide agonist comprises an amino acid sequence corresponding to the majority sequence depicted in FIG. 29 (SEQ ID NO:1397), further modified to incorporate at least one non-native glycosylation site. In some embodiments, a subject Type I interferon receptor polypeptide agonist comprises an amino acid sequence as set forth in any one of SEQ ID NOs:1399-1403, as set forth in FIG. 29.

Hybrid Type I Interferon Receptor Polypeptide Agonists with Non-native Glycosylation Site(s)

In some embodiments, a subject synthetic Type I interferon receptor polypeptide agonist comprises a hybrid Type I interferon receptor polypeptide agonist with one or more glycosylation sites. In other embodiments, a subject synthetic Type I interferon receptor polypeptide agonist comprises a hybrid type I interferon receptor polypeptide agonist with one or more glycosylation sites not found in any naturally occurring Type I interferon receptor polypeptide agonist. As used herein, a "hybrid Type I interferon receptor polypeptide agonist" is a polypeptide having an amino acid sequence comprising discrete sub-sequences corresponding in amino acid identity and number to sub-sequences of different, naturally occurring Type I interferon receptor polypeptide agonists, wherein the amino acid sequence of the subject synthetic polypeptide agonist differs from that of any naturally-occurring Type I interferon receptor polypeptide agonist. In some embodiments, the discrete sub-sequences are selected from IFN-α2b, IFN-α14, IFN-β1, and IFN-ω, and the amino acid sequence of the polypeptide agonist differs from the amino acid sequence of naturally occurring Type I interferon receptor polypeptide agonists IFN-α2b, IFN-α14, IFN-β1, and IFN-ω.

In other embodiments, the discrete sub-sequences can be selected from IFN-α2b, IFN-α14, IFN-β1, Infergen® consensus IFN-α, and IFN-ω, and the amino acid sequence of the polypeptide agonist differs from each of the amino acid sequences of the Type I interferon receptor polypeptide agonists IFN-α2b, IFN-α14, IFN-β1, Infergen® consensus IFN-α, and IFN-ω, respectively.

In some of these embodiments, the subject synthetic Type I interferon receptor polypeptide agonist is a hybrid Type I interferon receptor polypeptide agonist amino acid sequence containing one or more glycosylation sites originating from one or more of the parental Type I interferon receptor polypeptide agonist amino acid sequences used to derive the hybrid sequence. In additional embodiments, the hybrid sequence is further modified to incorporate at least one additional non-native glycosylation site (in addition to any non-native glycosylation site(s) originating from a parental Type I interferon receptor polypeptide agonist amino acid sequence).

It will be appreciated that the synthetic Type I interferon receptor polypeptide agonists of the invention include hybrid Type I interferon polypeptide agonists formed by substituting one or more amino acid residues in a parental IFN-α amino acid sequence with the amino acid residue or residues that form a native glycosylation site at a homologous position in another parental IFN-α amino acid sequence.

In one non-limiting example, the subject synthetic Type I interferon receptor polypeptide agonist is a hybrid Type I interferon receptor polypeptide agonist having a hybrid sequence formed by substituting KNSS for the native KDSS residues in the sequence of interferon alfa-2a or in the sequence of interferon alfa-2b. These synthetic Type I receptor polypeptide agonists are referred to herein as IFN-α2a (D102N) and IFN-α2b (D102N), respectively, where the amino acid sequence is that shown in FIG. 24.

In another non-limiting example, the subject synthetic Type I interferon receptor polypeptide agonist is a hybrid Type I interferon receptor polypeptide agonist having a hybrid sequence formed by substituting WNET for the native WDET residues in the sequence of interferon alfa-2a or in the sequence of interferon alfa-2b. These synthetic Type I receptor polypeptide agonists are referred to herein as IFN-α2a (D108N) and IFN-α2b (D108N), respectively, where the amino acid sequence is that shown in FIG. 24.

In another non-limiting example, the subject synthetic Type I interferon receptor polypeptide agonist is a hybrid Type I interferon receptor polypeptide agonist having a hybrid sequence formed by substituting KNSS and WNET for the native KDSS and WDET residues, respectively, in the sequence of interferon alfa-2a or in the sequence of interferon alfa-2b. These synthetic Type I receptor polypeptide agonists are referred to herein as IFN-α2a (D102N, D108N) and IFN-α2b (D102N, D108N), respectively, where the amino acid sequence is that shown in FIG. 24.

In other embodiments, the subject synthetic Type I interferon receptor polypeptide agonist is obtained from a hybrid sequence that does not have any glycosylation site(s) originating from a parental Type I interferon receptor polypeptide agonist amino acid sequence. In these embodiments, the hybrid sequence is then further modified to include at least one non-native glycosylation site in order to obtain the subject synthetic Type I interferon receptor polypeptide agonist. For example, in some embodiments, where the hybrid sequence includes KDSS, the KDSS sequence is modified to KNSS. As another non-limiting example, where the hybrid sequence includes WDET, the WDET sequence is modified to WNET. As another non-limiting example, where the hybrid sequence includes VEET, the VEET sequence is modified to VTET or VNET.

In some embodiments, a subject synthetic Type I interferon receptor polypeptide agonist comprises, in order from N-terminus to C-terminus, from about 2 to about 90, e.g., from about 2 to about 5, from about 5 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a first Type I interferon receptor polypeptide agonist selected from naturally-occurring human IFN-α2b (SEQ ID NO:1357), naturally-occurring human IFN-α14 (SEQ ID NO:1358), naturally occurring human IFN-β1 (SEQ ID NO:1359), and naturally-occurring human IFN-ω1 (SEQ ID NO:1360); and from about 2 to about 90, e.g., from about 2 to about 5, from about 5 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a second Type I interferon receptor polypeptide agonist selected from naturally-occurring human IFN-α2b, human IFN-α14, human IFN-β1, and human IFN-ω1, where the first and second Type I interferon receptor polypeptide agonists are different.

In some embodiments, a subject hybrid synthetic Type I interferon receptor polypeptide agonist further comprises from about 2 to about 90, e.g., from about 2 to about 5, from about 5 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a third Type I interferon receptor polypeptide agonist selected from naturally-occurring human IFN-α2b, human IFN-α14, human IFN-β1, and human IFN-ω1, where the third Type I interferon receptor polypeptide agonist is different from the first and second Type I interferon receptor polypeptide agonists.

In still other embodiments, a subject hybrid synthetic Type I interferon receptor polypeptide agonist further comprises from about 2 to about 90, e.g., from about 2 to about 5, from about 5 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a fourth Type I interferon receptor polypeptide agonist selected from naturally-occurring human IFN-α2b, human IFN-α14, human IFN-β1, and human IFN-ω1, where the fourth Type I interferon receptor polypeptide agonist is different from the first, second, and third Type I interferon receptor polypeptide agonists.

In particular embodiments, any of the above-described embodiments of a subject hybrid synthetic Type I interferon receptor polypeptide agonist comprises from about 4 to about 90, e.g., from about 4 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a segment of a human IFN-α14 polypeptide that includes at least the amino acid sequence KNSS of naturally occurring human IFN-α14.

In particular embodiments, any of the above-described embodiments of a subject hybrid synthetic Type I interferon receptor polypeptide agonist comprises from about 4 to about 90, e.g., from about 4 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a segment of a human IFN-β1 polypeptide that includes at least the amino acid sequence WNET of naturally occurring human IFN-β1.

In particular embodiments, any of the above-described embodiments of a subject hybrid synthetic Type I interferon receptor polypeptide agonist comprises from about 4 to about 90, e.g., from about 4 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a segment of a human IFN-ω1 polypeptide that includes at least the amino acid sequence WNMT of naturally occurring human IFN-ω1.

In particular embodiments, any of the above-described embodiments of a subject hybrid synthetic Type I interferon receptor polypeptide agonist comprises from about 4 to about 90, e.g., from about 4 to about 7, from about 7 to about 10, from about 10 to about 15, from about 15 to about 20, from about 20 to about 25, from about 25 to about 30, from about 30 to about 35, from about 35 to about 40, from about 40 to about 45, from about 45 to about 50, from about 50 to about 55, from about 55 to about 60, from about 60 to about 65, from about 65 to about 70, from about 75 to about 80, from about 80 to about 85, or from about 85 to about 90 contiguous amino acids of a segment of a human IFN-α2b polypeptide that includes at least the amino acid sequence VTET of naturally occurring human IFN-α2b.

Hybrid Type I Interferon Receptor Polypeptide Agonists with Non-native Glycosylation Site(s) Generated by DNA Shuffling Techniques In some embodiments, DNA shuffling techniques such as described in U.S. Pat. No. 6,132,970 may be used to generate hybrid type 1 interferons with desired glycosylation sites. DNA shuffling involves collecting a group of related genes in a suitable vessel. The collected gene group is then treated to fragment the collected genes resulting in a pool of gene fragments. In one non-limiting example, fragmentation is accomplished by treating the collected gene group with one or more selected nucleases. The pool of gene fragments is then heated to dissociate individual fragments. The heat-treated pool of gene fragments is then allowed to cool in order to permit the dissociated gene fragments to recombine at the sites of homology thus creating novel recombinations. The novel recombinations are extended, and the recombination process is repeated to create a library of novel full length genes which have a combination of characteristics of the starting parental genes.

In some embodiments, the genes encoding human Type 1 interferons or variant hyperglycosylated type 1 interferons (including consensus interferon alphacon-1) or hybrids of either are a group of homologous genes that encode polypeptides of similar biological activity. In one non-limiting example, two or more human type 1 interferon genes can be subjected to DNA shuffling techniques to generate a library of novel recombinant polynucleotides expressing polypeptides with similar biological functions. These novel polynucleotide molecules can contain gene fragments originating from any of the two or more species of human Type I interferons (including consensus interferon alphacon-1) selected for DNA shuffling and thus when these novel polynucleotides are expressed the resulting polypeptides can contain amino acid sequences common to any of the two or more species of human Type I interferons (including consensus interferon alphacon-1) whose genes were subjected to DNA shuffling.

In some embodiments, two or more variant hyperglycosylated type 1 interferon genes can be subjected to DNA shuffling techniques to generate a library of novel recombinant polynucleotides expressing polypeptides with similar biological functions. These novel polynucleotide molecules can contain gene fragments originating from any of the two or more species of variant hyperglycosylated Type I interferons (including consensus interferon alphacon-1) selected for DNA shuffling and thus when these novel polynucleotides are expressed the resulting polypeptides can contain amino acid sequences common to any of the two or more species of variant hyperglycosylated Type I interferons (including consensus interferon alphacon-1) whose genes were subjected to DNA shuffling.

In some embodiments, one or more human type I interferon and one or more variant hyperglycosylated type 1 interferon genes can be subjected to DNA shuffling techniques to generate a library of novel recombinant polynucleotides expressing polypeptides with similar biological functions. These novel polynucleotide molecules can contain gene fragments originating from any of the one or more species of variant hyperglycosylated Type I interferons (including consensus interferon alphacon-1) selected for DNA shuffling and from any of the one or more species of human Type I interferons (including consensus interferon alphacon-1) selected for DNA shuffling and thus when these novel polynucleotides are expressed the resulting polypeptides can contain amino acid sequences common to any of the one or more species of variant hyperglycosylated Type I interferons (including consensus interferon alphacon-1) or from any of the one of more species of human Type I interferons (including consensus interferon alphacon-1) whose genes were subjected to DNA shuffling.

In some embodiments, these novel molecules can be aligned with the naturally glycosylated Type I interferons and the corresponding glycosylation sites can be generated as a consequence of the DNA shuffling technique or additional glycosylation sites can be introduced in the same way as such site introduction has been described in this patent for non-glycosylated Type I interferons. These novel molecules can contain any one or more glycosylation sites selected from the group consisting of position 31, position 102, position 108, and position 138.

In some embodiments, the resulting hybrid gene obtained from gene shuffling can encode for a polypeptide with one or more specific mutations selected from the group consisting of D31N, L31S, D31N, K31N, D102N, S102N, T102N, R102N, I 102N, D108N, E108N, K108N, E138T, G138T, I138T, L138T, and P138T. In another non-limiting example, the resulting hybrid gene obtained from the combination of gene shuffling and the introduction of hyperglycosylation sites as described in this patent for non-glycosylated Type I interferons can encode for a polypeptide with one or more specific mutations selected from the group consisting of D31N, L31S, D31N, K31N, D102N, S102N, T102N, R102N, I102N, D108N, E108N, K108N, E138T, G138T, I138T, L138T, and P138T.

In some embodiments, the resulting polypeptide expressed by a hybrid gene obtained from gene shuffling can encode for a polypeptide with one or more specific mutations selected from the group consisting of D31N, L31S, D31N, K31N, D102N, S102N, T102N, R102N, I102N, D108N, E108N, K108N, E138T, G138T, I138T, L380T, and P150T. In another non-limiting example, the resulting polypeptide expressed by a hybrid gene obtained from the combination of gene shuffling and the introduction of hyperglycosylation sites as described in this patent for non-glycosylated Type I interferons can encode for a polypeptide with one or more specific mutations selected from the group consisting of D31N, L31S, D31N, K31N, D102N, S102N, T102N, R102N, I102N, D108N, E108N, K108N, E138T, G138T, I138T, L138T, and P138T.

Functional features

A subject synthetic polypeptide is a Type I interferon receptor polypeptide agonist, e.g., a subject synthetic Type I interferon receptor polypeptide agonist binds to and causes signal transduction via the Type I interferon receptor. Whether a subject synthetic Type I interferon receptor polypeptide agonist functions as a Type I interferon receptor agonist can be readily determined using any known assay. Such assays include, an in vitro cell-based assay to detect activation of interferon-responsive genes (e.g., using a reporter gene operably linked to a promoter containing one or more interferon responsive elements); and the like. Such assays also include KIRA assays for Type I interferon receptor activation activity as described in the "Diagnostic Uses" section below.

In some embodiments, a subject synthetic Type I interferon receptor polypeptide agonist exhibits one or more of the following activities: antiproliferative activity, anti-viral activity, and anti-fibrotic activity. Whether a subject synthetic Type I interferon receptor polypeptide agonist exhibits antiviral activity can be readily determined using any known assay, including e.g., an in vitro cell-based inhibition of viral replication assay. See, e.g., Patick et al. (11029) *Antimicrobial Agents and Chemotherapy* 43:2444-2450. Whether a subject synthetic Type I interferon receptor polypeptide agonist exhibits anti-proliferative activity can be readily determined using any known assay, including, e.g., an in vitro cell-based inhibition of proliferation assay.

A subject synthetic Type I interferon receptor polypeptide agonist exhibits one or more of the following properties: increased serum half-life; reduced immunogenicity in vivo; increased functional in vivo half-life; increased stability; reduced degradation by gastrointestinal tract conditions; and improved water solubility.

In some embodiments, a subject synthetic Type I interferon receptor polypeptide agonist has an increased serum half-life compared to a naturally occurring Type I interferon receptor polypeptide agonist or compared to a parent Type I interferon receptor polypeptide agonist. The term "serum half-life" is used interchangeably herein with the terms "plasma half-life," and "circulating half-life." In some embodiments, a subject synthetic Type I interferon receptor polypeptide agonist has a serum half life that is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3-fold, at least about 3.5-fold, at least about 4-fold, at least about 4.5-fold, or at least about 5-fold greater than the serum half life of a naturally-occurring Type I interferon receptor polypeptide agonist or parent Type I interferon receptor polypeptide agonist that lacks the non-native glycosylation site. In some embodiments, a subject synthetic Type I interferon receptor polypeptide agonist has a serum half life that is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3-fold, at least about 3.5-fold, at least about 4-fold, at least about 4.5-fold, or at least about 5-fold greater than the serum half life of a naturally-occurring Type I interferon receptor polypeptide agonist, or a Type I interferon receptor polypeptide agonist that has the same amino acid sequence as a naturally-occurring Type I interferon receptor agonist.

The serum half-life of a subject synthetic Type I interferon receptor polypeptide agonist is readily determined using well known methods. For example, a subject synthetic Type I interferon receptor polypeptide agonist is detectably labeled, and is administered to an individual (e.g., an experimental non-human animal, or a human subject), and, at various time points following administration of the agonist, a blood sample is drawn and the amount of detectably labeled synthetic Type I interferon receptor polypeptide agonist in the blood sample is determined.

In some embodiments, a subject synthetic Type I interferon receptor polypeptide agonist exhibits increased resistance to degradation by gastrointestinal tract conditions compared to a naturally occurring Type I interferon receptor polypeptide agonist or compared to a parent Type I interferon receptor polypeptide agonist. In some embodiments, a subject synthetic Type I interferon receptor polypeptide agonist exhibits at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, or at least about 90%, or greater, reduction of degradation in the gastrointestinal tract, compared to the level of degradation of a naturally-occurring Type I interferon receptor polypeptide agonist or parent Type I interferon receptor polypeptide agonist that lacks the non-native glycosylation site(s).

Whether a subject synthetic Type I interferon receptor polypeptide agonist exhibits increased resistance to degradation by gastrointestinal tract conditions can be readily determined using well-known methods. For example, a subject synthetic Type I interferon receptor polypeptide agonist is contacted in vitro with digestive enzymes found in the gastrointestinal tract, and the effect of the enzymes on the structural and functional integrity of the subject synthetic Type I interferon receptor polypeptide agonist determined. An in vivo method for determining resistance to degradation by gastrointestinal tract conditions can be used.

A known hyperglycosylated or protease-resistant, hyperglycosylated polypeptide variant suitable for use herein is a hyperglycosylated or protease-resistant, hyperglycosylated variant of a parent protein therapeutic, wherein the parent protein therapeutic is any protein therapeutic that is effective in the treatment of the disease or condition in a patient when administered to the patient. A list of exemplary protein therapeutics is provided below. A known hyperglycosylated or protease-resistant, hyperglycosylated polypeptide variant is effective in the treatment of the same disease or condition in a patient as the corresponding parent protein therapeutic.

Hyperglycosylated or Protease Resistant, Hyperglycosylated Polypeptide Variants

A known hyperglycosylated or protease-resistant, hyperglycosylated polypeptide variant is a hyperglycosylated or protease-resistant, hyperglycosylated variant of a protein therapeutic, and is in many embodiments provided in a first unit form. The first unit form can comprise a first number of moles of the known hyperglycosylated or protease-resistant, hyperglycosylated polypeptide variant in an oral pharmaceutical composition. The parent protein therapeutic in many embodiments can be in an immediate release formulation suitable for subcutaneous bolus injection, i.e. a second unit form, where the first number of moles in the first unit form is greater than a second number of moles of the protein therapeutic in the second unit form. For example, the first number of moles can be at least about 5%, at least about 10%, at least about 15%, at least about 20%, at least about 25%, at least about 30%, at least about 35%, at least about 40%, at least about 45%, or at least about 50%, or at least about 75%, or at least about 100%, or at least about three-fold, or at least about four-fold, or at least about five-fold, or at least about six-fold, or at least about seven-fold, or at least about eight-fold, or at least about nine-fold, or at least about ten-fold, or more, greater than the second number of moles.

In many embodiments, upon oral administration of the first unit form to a patient, the time required for release of the first number of moles of the known hyperglycosylated or protease-resistant, hyperglycosylated polypeptide variant is no longer than the period of time that elapses between doses of the parent protein therapeutic when administered in the second unit form by subcutaneous bolus injection at a selected dosing frequency in a therapeutic regimen that is proven to be effective for treating the disease or condition of the patient. Thus, e.g., the time required for release of the first number of moles of the hyperglycosylated or protease-resistant, hyperglycosylated polypeptide variant upon oral administration of the first unit form can be at least about 5%, at least about 10%, at least about 15%, at least about 20%, at least about 25%, at least about 30%, at least about 35%, at least about 40%, at least about 45%, or at least about 50%, or more, less than the time interval between doses of the parent therapeutic in the second unit form when administered by subcutaneous bolus injection at the selected dosing frequency. In some embodiments, the first unit form is in an immediate release formulation suitable for oral delivery.

A hyperglycosylated or protease-resistant, hyperglycosylated polypeptide variant can be administered by mouth more frequently than the corresponding parent polypeptide is administered by subcutaneous bolus injection. For example, a hyperglycosylated or protease-resistant, hyperglycosylated polypeptide variant can be administered by mouth at least twice as frequently, at least 2⅓ times more frequently, at least 2.5 times more frequently, at least three times more frequently, at least 3.5 times more frequently, or at least four times more frequently, or at least five times more frequently, or at least six times more frequently, or more frequently, than the corresponding parent polypeptide is administered by subcutaneous bolus injection. Thus, e.g., where a parent polypeptide therapeutic is administered once weekly, the corresponding protease-resistant or protease-resistant, hyperglycosylated polypeptide variant can be administered twice weekly, three times weekly, once daily, twice daily, three times daily, or more than three times daily.

As one non-limiting example, the parent protein therapeutic is IFN-γ1b, and the IFN-γ1b is administered in a unit dosage form suitable for subcutaneous injection at a dosage of $1 \times 10^6$ International Units (IU)/m$^2$ (or 50 μg/m$^2$ or $3.0 \times 10^{-9}$ mol./m$^2$) subcutaneously three times per week, for a total weekly dose of 150 μg/m$^2$ (or $3 \times 10^6$ IU/m or $9.0 \times 10^{-9}$ mol./m$^2$). A desired hyperglycosylated, protease-resistant variant of IFN-γ1b is in a unit dosage form suitable for oral delivery; the known hyperglycosylated, protease-resistant IFN-γ1b variant is administered orally, and more frequently than 3 times per week (e.g., 4 times per week, 5 times per week, 6 times per week, once daily, twice daily, or three times daily); and the total weekly dose of hyperglycosylated, protease-resistant IFN-γ1b variant that is administered is greater than or equal to $9.0 \times 10^{-9}$ mol./m$^2$, e.g., the total weekly dose is from about $9.0 \times 10^{-9}$ mol./m$^2$ to about $1.0 \times 10^{-8}$ mol./m$^2$, from about $1.0 \times 10^{-8}$ mol./m$^2$ to about $2.5 \times 10^{-8}$ mol./m$^2$, from about $2.5 \times 10^{-8}$ mol./m$^2$ to about $5.0 \times 10^{-8}$ mol./m$^2$, or from about $5.0 \times 10^{-8}$ mol./m$^2$ to about $7.5 \times 10^{-8}$ mol./m$^2$, or from about $7.5 \times 10^{-8}$ mol./m$^2$ to about $1.0 \times 10^{-7}$ mol./m$^2$, or from about $1.0 \times 10^{-7}$ mol./m$^2$ to about $1.0 \times 10^{-6}$ mol./m$^2$.

In another aspect, the total weekly dose of hyperglycosylated, protease-resistant IFN-γ1b variant that is administered is greater than or equal to 500 μg, e.g., from about 500 μg to about 750 μg, from about 750 μg to about 1,000 μg, from about 1,000 μg to about 1,500 μg, or from about 1,500 μg to about 2,000 μg.

A hyperglycosylated or protease-resistant, hyperglycosylated polypeptide variant exhibits increased protease resistance compared to the corresponding parent polypeptide. In some embodiments, a hyperglycosylated or protease-resistant, hyperglycosylated polypeptide variant exhibits resistance to serum proteases that is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3-fold, at least about 3.5-fold, at least about 4-fold, at least about 4.5-fold, at least about 5-fold (at least about 5 times), at least about 6-fold, at least about 7-fold, at least about 8-fold, at least about 9-fold, at least about 10-fold, at least about 20-fold, at least about 30-fold, at least about 40-fold, at least about 50-fold, at least about 60-fold, at least about 70-fold, at least about 80-fold, at least about 90-fold, at least about 100-fold, at least about 200-fold, at least about 300-fold, at least about 400-fold, at least about 500-fold, at least about 600-fold, at least about 700-fold, at least about 800-fold, at least about 900-fold, or at least about 1000-fold, or more, greater than the resistance to serum proteases of the corresponding parent protein therapeutic, in human blood, human serum, or an in vitro mixture containing one or more proteases.

In some embodiments, a hyperglycosylated or protease-resistant, hyperglycosylated polypeptide variant exhibits at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3-fold, at least about 3.5-fold, at least about 4-fold, at least about 4.5-fold, at least about 5-fold (at least about 5 times), at least about 6-fold, at least about 7-fold, at least about 8-fold, at least about 9-fold, at least about 10-fold, at least about 20-fold, at least about 30-fold, at least about 40-fold, at least about 50-fold, at least about 60-fold, at least about 70-fold, at least about 80-fold, at least about 90-fold, at least about 100-fold, at least about 200-fold, at least about 300-fold, at least about 400-fold, at least about 500-fold, at least about 600-fold, at least about 700-fold, at least about 800-fold, at least about 900-fold, or at least about 1000-fold, or more, greater resistance to one or more of α chymotrypsin, endoproteinase Arg-C, endoproteinase Asp-N, endoproteinase Glu-C, endoproteinase Lys-C, and trypsin, compared to the corresponding parent protein therapeutic.

In some embodiments, the extent of the increase in protease resistance of the polypeptide variant is determined by comparing the half-life of the polypeptide variant to the half-life of the corresponding parent protein therapeutic in human blood or human serum in vitro, or in an in vitro composition comprising one or more serum proteases. For example, the resistance to protease cleavage can be determined by detecting the level of a biological activity of a protease-resistant polypeptide variant following separately contacting the polypeptide variant and the corresponding parent protein therapeutic with a mixture of proteases, with human serum, or with human blood; and comparing the activity of the polypeptide variant to that of the corresponding parent protein therapeutic. If the biological activity of the polypeptide variant is higher than that of the corresponding parent protein therapeutic following incubation with human blood, human serum, or one or more proteases, then the polypeptide variant has increased protease resistance compared to the parent protein therapeutic.

The following is one non-limiting example of an in vitro assay for determining protease resistance. In separate containers, a polypeptide variant and the corresponding parent protein therapeutic are added to a mixture of proteases containing 1.5 pg each of α-chymotrypsin, carboxypeptidase, endoproteinase Arg-C, endoproteinase Asp-N, endoproteinase Glu-C, endoproteinase Lys-C, and trypsin, forming a reaction mixture; and the reaction mixture kept at 25° C. for 30 minutes. At the end of the 30-minute reaction period, an agent that inhibits the activity of the proteases is added; and a biological activity of the polypeptide variant and the corresponding parent protein therapeutic is detected. The following is another non-limiting example of an in vitro assay for determining protease resistance. In separate containers, a polypeptide variant and the corresponding parent protein therapeutic are added to either a lysate of human blood, or human serum, forming a reaction mixture; and the reaction mixture is kept at 37° C. for a suitable period of time (e.g., 5 minutes, 10 minutes, 15 minutes, 30 minutes, or 60 minutes, etc.). An agent that inhibits the activity of the proteases is then added; and a biological activity of the polypeptide variant and the corresponding parent protein therapeutic is detected.

The corresponding parent protein therapeutic can be any parent protein therapeutic that is proven to be effective in the treatment of the disease or condition in a patient when administered to the patient in an immediate release formulation by subcutaneous bolus injection of the second unit form at a suitable dosing frequency. In these embodiments, the hyperglycosylated or protease-resistant, hyperglycosylated polypeptide variant is effective in the treatment of the same disease or condition in the patient when administered to the patient orally in the first unit form at a dosing frequency that is no less often than that of the parent protein therapeutic regimen.

In many embodiments, a known hyperglycosylated, protease-resistant polypeptide variant exhibits a desired pharmacologic activity in a mammalian host, e.g., a hyperglycosylated, protease-resistant polypeptide variant can exhibit at least about 50%, at least about 60%, at least about 70%, at least about 80%, at least about 90%, or at least about 95%, of a desired pharmacologic activity of a corresponding parent protein therapeutic. As non-limiting examples, a hyperglycosylated, protease-resistant polypeptide variant can exhibit one or more of the following activities: antiproliferative activity, anti-viral activity, anti-fibrotic activity; hematopoietic activity; angiogenic activity; enzymatic activity; growth factor activity; chemokine activity; receptor agonist activity; receptor antagonist activity; and anti-angiogenic activity; where the activity is one that is desired of a corresponding parent protein therapeutic.

A known hyperglycosylated, protease-resistant polypeptide variant exhibits increased serum half-life or increased AUC compared to a parent protein therapeutic administered under similar conditions.

In some embodiments, a known hyperglycosylated, protease-resistant polypeptide variant has an increased serum half-life compared to the corresponding parent polypeptide. The term "serum half-life" is used interchangeably herein with the terms "plasma half-life," and "circulating half-life." In some embodiments, a hyperglycosylated, protease-resistant polypeptide variant has a serum half life that is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3-fold, at least about 3.5-fold, at least about 4-fold, at least about 4.5-fold, at least about 5-fold (at least about 5 times), at least about 6-fold, at least about 7-fold, at least about 8-fold, at least about 9-fold, at least about 10-fold, at least about 20-fold, at least about 30-fold, at least about 40-fold, at least about 50-fold, at least about 60-fold, at least about 70-fold, at least about 80-fold, at least about 90-fold, at least about 100-fold, at least about 200-fold, at least about 300-fold, at least about 400-fold, at least about 500-fold, at least about 600-fold, at least about 700-fold, at least about 800-fold, at least about 900-fold, or at least about 1000-fold, or more, greater than the serum half life of the corresponding parent protein therapeutic. In some embodiments, the extent of the increase in half-life of the known hyperglycosylated, protease-resistant polypeptide variant is determined by comparing the half-life of the known hyperglycosylated, protease-resistant polypeptide variant to the half-life of the corresponding parent protein therapeutic in human blood or human serum in vivo.

In some embodiments, the extent of the increase in half-life of the known hyperglycosylated, protease-resistant polypeptide variant is determined by comparing the half-life of the known hyperglycosylated, protease-resistant polypeptide variant to the half-life of the corresponding parent protein therapeutic in human blood or human serum in vitro, or in an in vitro composition comprising one or more serum proteases. For example, the resistance to protease cleavage can be determined by detecting the level of a biological activity of a known hyperglycosylated, protease-resistant polypeptide variant following separately contacting the polypeptide variant and the corresponding parent protein therapeutic with a mixture of proteases, with human serum, or with human blood; and comparing the activity of the polypeptide variant to that of the corresponding parent protein therapeutic. If the biological activity of the polypeptide variant is higher than that of the corresponding parent protein therapeutic following incubation with human blood, human serum, or one or more proteases, then the polypeptide variant has an increased half-life compared to the parent protein therapeutic.

In some embodiments, a known hyperglycosylated, protease-resistant polypeptide variant has an AUC that is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 100% (or two-fold), at least about 2.5-fold, at least about 3fold, at least about 3.5-fold, at least about 4-fold, at least about 4.5-fold, or at least about 5-fold greater than the AUC of the corresponding parent protein therapeutic when administered under similar conditions.

The serum half-life or AUC of a known hyperglycosylated, protease-resistant polypeptide variant can be readily determined using well known methods. For example, a known hyperglycosylated, protease-resistant polypeptide variant is detectably labeled, and is administered to an individual (e.g., an experimental non-human animal, or a human subject), and, at various time points following administration of the hyperglycosylated, protease-resistant polypeptide variant, a blood sample is drawn and the amount of detectably labeled hyperglycosylated, protease-resistant polypeptide variant in the blood sample is determined.

3D-scanning Methods

A glycosylated or protease-resistant or protease-resistant, hyperglycosylated polypeptide variant of a parent protein therapeutic can be generated using a 3D-scanning (structural homology) method. Structural homology refers to homology between the topology and three-dimensional structure of two proteins. Numerous methods are well known in the art for identifying structurally related amino acid positions with 3-dimensionally structurally homologous proteins. Exemplary methods include, but are not limited to: CATH (Class, Architecture, Topology and Homologous superfamily) which is a hierarchical classification of protein domain structures based on four different levels (Orengo et al., Structure, 5(8): 1093-1108, 11027); CE (Combinatorial Extension of the optimal path), which is a method that calculates pairwise structure alignments (Shindyalov et al., Protein Engineering, 11 (9):739-747, 11028); FSSP (Fold classification based on Structure-Structure alignment of Proteins), which is a database based on the complete comparison of all 3-dimensional protein structures that currently reside in the Protein Data Bank (PDB) (Holm et al., Science, 273:595-602, 11026); SCOP (Structural Classification of Proteins), which provides a descriptive database based on the structural and evolutionary relationships between all proteins whose structure is known (Murzin et al., J. Mol. Biol., 247:536-540, 11025); and VAST (Vector Alignment Search Tool), which compares newly determined 3-dimensional protein structure coordinates to those found in the MMDB/PDB database (Gibrat et al., Current Opinion in Structural Biology, 6:377-385, 11025).

As one non-limiting example, IFN-α2b mutants with increased resistance to proteolysis are generated by a 2-dimensional rational scanning method; and the corresponding residues on members of cytokine families that possess structural homology to IFN-α2b are identified and the identified residues on the other cytokines are similarly modified to produce cytokines with increased resistance to proteolysis. See, e.g., WO 04/022593.

Protein Therapeutics

A hyperglycosylated or protease-resistant, hyperglycosylated polypeptide variant is a variant of a polypeptide that has a therapeutic function in a mammalian host ("a parent protein therapeutic") in the treatment of a disease or condition in the mammalian host. A hyperglycosylated or protease-resistant, hyperglycosylated polypeptide variant treats the same disease or condition in the host as a parent protein therapeutic.

It should be noted that, in the context of amino acid replacements for generating protease-resistant variants of a parent protein therapeutic, the numbering of amino acids used to describe amino acid replacements that alter a protease cleavage site coincides with the numbering of amino acids as set forth in FIGS. 1-23. In the context of amino acid replacements for generating hyperglycosylation variants of the parent protein therapeutic, the numbering of amino acids used to describe amino acid replacements that generate a glycosylation site coincides with the numbering of amino acids as set forth in FIGS. 24-30. The corresponding amino acid positions of an IFN-α depicted in, e.g., FIG. 1 and FIG. 24 are readily identified. For example, it will be readily apparent to those skilled in the art that D99 of IFN-α2b depicted in FIG. 24 corresponds to D71 of IFN-α2b depicted in FIG. 2, and corresponds to D71 of IFN-α2a depicted in FIG. 1. Thus, e.g., D99 and D102 of the IFN-α2b amino acid sequence depicted in FIG. 24 correspond to D71 and D77, respectively of the IFN-α2a amino acid sequence depicted in FIG. 1 and of the IFN-α2b amino acid sequence depicted in FIG. 2; R50 of the IFN-α2b amino acid sequence depicted in FIG. 24 corresponds to R23 of the IFN-α2b amino acid sequence depicted in FIG. 2; D99, D105, and E134 of the Infergen amino acid sequence depicted in FIG. 24 correspond to D72, D78, and E107, respectively, of the consensus IFN-α amino acid sequence set forth in FIG. 9; the S74, E134, and F136 amino acid positions of the IFN-β1 amino acid sequence set forth in FIG. 24 correspond to S74, E109, and F111, respectively, in the IFN-β amino acid sequence set forth in FIG. 3; and the E38, S40, and S99 amino acid positions of the IFN-γ amino acid sequence set forth in FIG. 31 correspond to E41, S43, and S102, respectively, of the IFN-γ amino acid sequence set forth in FIG. 4.

Suitable protease-resistant or protease-resistant, hyperglycosylated polypeptide variants include protease-resistant or protease-resistant, hyperglycosylated forms of any parent protein therapeutic that a mammalian host is in need of, including, but not limited to: an interferon (e.g., IFN-γ, IFN-α, IFN-β, IFN-ω; IFN-τ; IFN-κ; as described in more detail below); an insulin (e.g., Novolin, Humulin, Humalog, Lantus, Ultralente, etc.); an erythropoietin (e.g., Procrit®, Eprex®, or Epogen® (epoetin-α); Aranesp® (darbepoetin-α); NeoRecormon®, Epogin® (epoetin-β); and the like); an antibody (e.g., a monoclonal antibody) (e.g., Rituxan® (rituximab); Remicade® (infliximab); Herceptin® (trastuzumab); Humira™ (adalimumab); Xolair® (omalizumab); Bexxar® (tositumomab); Raptiva™ (efalizumab); Erbitux™ (cetuximab); and the like), including an antigen-binding fragment of a monoclonal antibody; a blood factor (e.g., Activase® (alteplase) tissue plasminogen activator; NovoSeven® (recombinant human factor VIIa); Factor VIIa; Factor VIII (e.g., Kogenate®); Factor IX; β-globin; hemoglobin; and the like); a colony stimulating factor (e.g., Neupogen® (filgrastim; G-CSF); Neulasta (pegfilgrastim); granulocyte colony stimulating factor (G-CSF), granulocyte-monocyte colony stimulating factor, macrophage colony stimulating factor, megakaryocyte colony stimulating factor; and the like); a growth hormone (e.g., a somatotropin, e.g., Genotropin®, Nutropin®, Norditropin®, Saizen®, Serostim®, Humatrope®, etc.; a human growth hormone; and the like); an interleukin (e.g., IL-1; IL-2, including, e.g., Proleukin®; IL-3, IL-4, IL-5, IL-6, IL-7, IL-8, IL-9; etc.); a growth factor (e.g., Regranex® (beclapermin; PDGF); Fiblast® (trafermin; bFGF); Stemgen® (ancestim; stem cell factor); keratinocyte growth factor; an acidic fibroblast growth factor, a stem cell factor, a basic fibroblast growth factor, a hepatocyte growth factor; and the like); a soluble receptor (e.g., a TNF-α-binding soluble receptor such as Enbrel® (etanercept); a soluble VEGF receptor; a soluble interleukin receptor; a soluble γ/δ T cell receptor; and the like); an enzyme (e.g., α-glucosidase; Cerazyme® (imiglucarase; β-glucocerebrosidase, Ceredase® (alglucerase); an enzyme activator (e.g., tissue plasminogen activator); a chemokine (e.g., IP-10; Mig; Groα/IL-8, RANTES; MIP-1a; MIP-1β; MCP-1; PF-4; and the like); an angiogenic agent (e.g., vascular endothelial growth factor (VEGF); an anti-angiogenic agent (e.g., a soluble VEGF receptor); a protein vaccine; a neuroactive peptide such as bradykinin, cholecystokinin, gastin, secretin, oxytocin, gonadotropin-releasing hormone, beta-endorphin, enkephalin, substance P, somatostatin, prolactin, galanin, growth hormone-releasing hormone, bombesin, warfarin, dynorphin, neurotensin, motilin, thyrotropin, neuropeptide Y, luteinizing hormone, calcitonin, insulin, glucagon, vasopressin, angiotensin II, thyrotropin-releasing hormone, vasoactive intestinal peptide, a sleep peptide, etc.; other proteins such as a thrombolytic agent, an atrial natriuretic peptide, bone morphogenic protein, thrombopoietin, relaxin, glial fibrillary acidic protein, follicle stimulating hormone, a human alpha-1 antitrypsin, a leukemia inhibitory factor, a transforming growth factor, a tissue factor, an insulin-like growth factor, a luteinizing hormone, a follicle stimulating hormone, a macrophage activating factor, tumor necrosis factor, a neutrophil chemotactic factor, a nerve growth factor, a tissue inhibitor of metalloproteinases; a vasoactive intestinal peptide, angiogenin, angiotropin, fibrin; hirudin; a leukemia inhibitory factor; an IL-1 receptor antagonist (e.g., Kineret® (anakinra)); and the like. Also suitable for use are fusion proteins comprising all or a portion of any of the foregoing proteins.

As mentioned above, a hyperglycosylated or protease-resistant, hyperglycosylated protein variant exhibits at least one desired pharmacologic activity of the corresponding parent protein. Examples of useful assays for particular therapeutic proteins include, but are not limited to, GMCSF (Eaves, A. C. and Eaves C. J., Erythropoiesis in culture. In: McCullock E A (edt) Cell culture techniques—Clinics in hematology. W B Saunders, Eastbourne, pp 371-91 (1984); Metcalf, D., International Journal of Cell Cloning 10: 116-25 (11022); Testa, N. G., et al., Assays for hematopoietic growth factors. In: Balkwill F R (edt) Cytokines A practical Approach, pp 229-44; IRL Press Oxford 11021) EPO (bioassay: Kitamura et al., J. Cell. Physiol. 140 p323 (1989)); Hirudin (platelet aggregation assay: Blood Coagul Fibrinolysis 7(2):259-61 (11026)); IFNα(anti-viral assay: Rubinstein et al., J. Virol. 37(2):755-8 (1981); anti-proliferative assay: Gao Y, et al Mol Cell Biol. 19(11):7305-13 (11029); and bioassay: Czarniecki et al., J. Virol. 49 p490 (1984)); GCSF (bioassay: Shirafuji et al., Exp. Hematol. 17 p116 (1989); proliferation of murine NFS-60 cells (Weinstein et al, Proc Natl Acad Sci 83:5010-4 (1986)); insulin (3H-glucose uptake assay: Steppan et al., Nature 409 (6818):307-12 (2001)); hGH (Ba/F3-hGHR proliferation assay: J Clin Endocrinol Metab 85(11):4274-9 (2000); International standard for growth hormone: Horm Res, 51 Suppl 1:7-12 (11029)); factor X (factor X activity assay: Van Wijk et al. Thromb Res 22:681-686 (1981)); factor VII (coagulation assay using prothrombin clotting time: Belaaouaj et al., J. Biol. Chem. 275:27123-8(2000); Diaz-Collier et al., Thromb Haemost 71:339-46 (11024)).

Interferons

In some embodiments, the parent protein therapeutic is an interferon, and a hyperglycosylated or protease-resistant, hyperglycosylated polypeptide variant comprises (1) a carbohydrate moiety covalently attached to at least one non-native glycosylation site not found in the parent interferon or (2) a carbohydrate moiety covalently attached to at least one native glycosylation site found but not glycosylated in the parent interferon; and comprises one or more mutated protease cleavage sites in place of a native protease cleavage site found in the parent protein therapeutic.

In some embodiments, the parent polypeptide is a Type I interferon receptor polypeptide agonist. Type I interferon receptor polypeptide agonists include IFN-α, IFN-β, IFN-τ, IFN-κ and IFN-ω. Thus, e.g., a protease-resistant or protease-resistant, hyperglycosylated polypeptide variant can be a protease-resistant or protease-resistant, hyperglycosylated Type I interferon receptor polypeptide agonist variant, including hyperglycosylated IFN-α, IFN-β, IFN-τ, IFN-κ and IFN-ω variants that lack at least one protease cleavage site found in the parent protein.

In other embodiments, the hyperglycosylated or protease-resistant, hyperglycosylated polypeptide variant is any protease-resistant or protease-resistant, glycosylated synthetic Type I interferon receptor polypeptide agonist described in the U.S. Provisional Patent Application for "Synthetic Type I Interferon Receptor Polypeptide Agonists" (U.S. Ser. No. 60/600,202) filed on Aug. 9, 2004, the entire disclosure of which application is incorporated herein by reference.

In other embodiments, the parent polypeptide is a Type II interferon receptor polypeptide agonist. Type II interferon receptor polypeptide agonists include interferon-gamma (IFN-γ). Thus, e.g., a protease-resistant or protease-resistant, hyperglycosylated polypeptide variant can be a protease-resistant or protease-resistant, hyperglycosylated Type II interferon receptor polypeptide agonist variant, including hyperglycosylated IFN-γ that lacks at least one protease cleavage site found in the parent protein.

IFN-α

The amino acid sequence of any known IFN-α can be modified to generate a subject synthetic Type I interferon receptor polypeptide agonist. The term "interferon-alpha" as used herein refers to a family of related polypeptides that inhibit viral replication and cellular proliferation and modulate immune response.

Suitable alpha interferons include, but are not limited to, naturally-occurring IFN-α (including, but not limited to, naturally occurring IFN-α1, IFN-α2a, IFN-α2b, IFN-α4a, IFN-α4a, IFN-α5, IFN-α6, IFN-α7, IFN-α8, IFN-α10, IFN-α13, IFN-α14, IFN-α16, IFN-α17, IFN-α21, IFN-αH, IFN-I and IFN-αJ1); an IFN-α as described in U.S. Pat. No. 6,704,225; recombinant interferon alpha-2b such as Intron-A interferon available from Schering Corporation, Kenilworth, N.J.; recombinant interferon alpha-2a such as Roferon interferon available from Hoffmann-La Roche, Nutley, N.J.; recombinant interferon alpha-2C such as Berofor alpha 2 interferon available from Boehringer Ingelheim Pharmaceutical, Inc., Ridgefield, Conn.; interferon alpha-n1, a purified blend of natural alpha interferons such as Sumiferon available from Sumitomo, Japan or as Wellferon interferon alpha-n1 (INS) available from the Glaxo-Wellcome Ltd., London, Great Britain; and interferon alpha-n3 a mixture of natural alpha interferons made by Interferon Sciences and available from the Purdue Frederick Co., Norwalk, Conn., under the Alferon Tradename; and IFN-α14.

Suitable hyperglycosylated or protease-resistant, hyperglycosylated polypeptide variants include protease-resistant or protease-resistant, hyperglycosylated forms of any parent alpha interferon polypeptide. In one aspect, a hyperglycosylated or protease-resistant, hyperglycosylated variant of a parent alpha interferon polypeptide has an amino acid sequence that differs from the amino acid sequence of the parent polypeptide to the extent that the variant comprises one or more glycosylation sites not found in the parent polypeptide; and further comprises at least one mutated protease cleavage site in place of a native protease cleavage site found in the parent protein.

In another aspect, the parent polypeptide is IFN-α2a and the hyperglycosylated or protease-resistant, hyperglycosylated polypeptide variant is an [D102N]IFN-α2a glycopeptide, where the [D102N]IFN-α2a glycopeptide is a variant of IFN-α2a having (a) an asparagine residue in place of the native aspartic acid residue at amino acid position 102 in the amino acid sequence of IFN-α2a and (b) a carbohydrate moiety covalently attached to the R-group of said asparagine residue. It will be appreciated that the amino acid sequence of IFN-α2a is the same as the amino acid sequence of IFN-α2b depicted in FIG. 1, provided that the IFN-α2a sequence has a lysine residue in place of the arginine residue at amino acid position 50 in the IFN-α2b sequence shown in FIG. 24.

In another aspect, the parent polypeptide is IFN-α2a and the hyperglycosylated or protease-resistant, hyperglycosylated polypeptide variant is an [D102N, D108N] IFN-α2a glycopeptide, where the [D102N, D108N]IFN-α2a glycopeptide is a variant of IFN-α2a having (a) an asparagine residue in place of the native aspartic acid residue at each of amino acid positions 102 and 108 in the amino acid sequence of IFN-α2a and (b) a carbohydrate moiety covalently attached to the R-group of each of said asparagine residues. It will be appreciated that the amino acid sequence of IFN-α2a is the same as the amino acid sequence of IFN-α2b depicted in FIG. 1, provided that the IFN-α2a sequence has a lysine residue in place of the arginine residue at amino acid position 50 in the IFN-α2b sequence shown in FIG. 24.

In another aspect, the following non-limiting list of hyperglycosylated variants of IFN-α2a are described: [D31N]interferon α2a (SEQ ID No.:1423), [D102N]interferon α2a (SEQ ID No.:1424), [D108N]interferon α2a (SEQ ID No.:1425), [D31N, D102N]interferon α2a (SEQ ID No.:1427), [D31N, D108N]interferon α2a (SEQ ID No.:1428), [D102N, D108N]interferon α2a (SEQ ID No.:1430), [D31N, D102N, D108N]interferon α2a (SEQ ID No.:1433).

In another aspect, the parent polypeptide is IFN-α2b and the hyperglycosylated or protease-resistant, hyperglycosylated polypeptide variant is an [D102N]IFN-α2b glycopeptide, where the [D102N]IFN-α2b glycopeptide is a variant of IFN-α2b having (a) an asparagine residue in place of the native aspartic acid residue at amino acid position 102 in the amino acid sequence of IFN-α2b depicted in FIG. 1 and (b) a carbohydrate moiety covalently attached to the R-group of said asparagine residue.

In another aspect, the parent polypeptide is IFN-α2b and the hyperglycosylated or protease-resistant, hyperglycosylated polypeptide variant is an [D102N, D108N]IFN-α2b glycopeptide, where the [D102N, D108N]IFN-α2b glycopeptide is a variant of IFN-α2b having (a) an asparagine residue in place of the native aspartic acid residue at each of amino acid positions 102 and 108 in the amino acid sequence of IFN-α2b depicted in FIG. 1 and (b) a carbohydrate moiety covalently attached to the R-group of each of said asparagine residues.

In another aspect, the following non-limiting list of hyperglycosylated variants of IFN-α2b are described: [D31N]interferon α2b (SEQ ID No.:1439), [D102N]interferon α2b (SEQ ID No.:1440), [D108N]interferon α2b (SEQ ID No.:1441), [D31N, D102N]interferon α2b (SEQ ID No.:1443), [D31N, D108N]interferon α2b (SEQ ID No.:1444), [D102N, D108N]interferon α2b (SEQ ID No.:1446), [D31N, D102N, D108N]interferon α2b (SEQ ID No.:1449).

In another aspect, the following non-limiting list of hyperglycosylated variants of IFN-α1 are described: [D31N]interferon α 1 (SEQ ID No.:1407), [D102N]interferon α1 (SEQ ID No.:1408), [D108N]interferon α1 (SEQ ID No.:1409), [G138T]interferon α1 (SEQ ID No.:1410), [D31N, D102N] interferon α1 (SEQ ID No.:1411), [D31N, D108N]interferon α1 (SEQ ID No.:1412), [D31N, G138T]interferon α1 (SEQ ID No.:1413), [D102N, D108N]interferon α1 (SEQ ID No.:1414), [D102N, G138T]interferon α1 (SEQ ID No.:1415), [D108N, G138T]interferon α1 (SEQ ID No.:1416), [D31N, D102N, D108N]interferon α1 (SEQ ID No.:1417), [D31N, D102N, G138T]interferon α1 (SEQ ID No.:1418), [D31N, D108N, G138T]interferon α1 (SEQ ID No.:1419), [D102N, D108N, G138T]interferon α1 (SEQ ID No.:1420), and [D31N, D102N, D108N, G138T]interferon α1 (SEQ ID No.:1421).

In another aspect, the following non-limiting list of hyperglycosylated variants of IFN-α4a are described: [D31N]interferon α4a (SEQ ID No.:1455), [D102N]interferon α4a (SEQ ID No.:1456), [E108N]interferon α4a (SEQ ID No.:1457), [E138T]interferon α4a (SEQ ID No.:1458), [D31N, D102N]interferon α4a (SEQ ID No.:1459), [D31N, E108N] interferon α4a (SEQ ID No.:1460), [D31N, E138T]interferon α4a (SEQ ID No.:1461), [D102N, E108N]interferon α4a (SEQ ID No.:1462), [D102N, E138T]interferon α4a (SEQ ID No.:1463), [E108N, E138T]interferon α4a (SEQ ID No.:1464), [D31N, D102N, E108N]interferon α4a (SEQ ID No.:1465), [D31N, D102N, E138T]interferon α4a (SEQ ID No.:1466), [D31N, E108N, E138T]interferon α4a (SEQ ID No.:1467), [D102N, E108N, E138T]interferon α4a (SEQ ID No.:1468), and [D31N, D102N, E108N, E138T]interferon α4a (SEQ ID No.:1469).

In another aspect, the following non-limiting list of hyperglycosylated variants of IFN-α4b are described: [D31N]interferon α4b (SEQ ID No.:1471), [D102N]interferon α4b (SEQ ID No.:1472), [E108N]interferon α4b (SEQ ID No.:1473), [E138T]interferon α4b (SEQ ID No.:1474), [D31N, D102N]interferon α4b (SEQ ID No.:1475), [D31N, E108N] interferon α4b (SEQ ID No.:1476), [D31N, E138T]interferon α4b (SEQ ID No.:1477), [D102N, E108N]interferon α4b (SEQ ID No.:1478), [D102N, E138T]interferon α4b (SEQ ID No.:1479), [E108N, E138T]interferon α4b (SEQ ID No.:1480), [D31N, D102N, E108N]interferon α4b (SEQ ID No.:1481), [D31N, D102N, E138T]interferon α4b (SEQ ID No.:1482), [D31N, E108N, E138T]interferon α4 (SEQ ID No.:1483), [D102N, E108N, E138T]interferon α4b (SEQ ID No.:1484), and [D31N, D102N, E108N, E138T]interferon α4b (SEQ ID No.:1485).

In another aspect, the following non-limiting list of hyperglycosylated variants of IFN-α5 are described: [D31N]interferon α5 (SEQ ID No.:1487), [D102N]interferon α5 (SEQ ID No.:1488), [D108N]interferon α5 (SEQ ID No.:1489), [E138T]interferon α5 (SEQ ID No.:1490), [D31N, D102N] interferon α5 (SEQ ID No.:1491), [D31N, D108N]interferon α5 (SEQ ID No.:1492), [D31N, E138T]interferon α5 (SEQ ID No.:1493), [D102N, D108N]interferon α5 (SEQ ID No.:1494), [D102N, E138T]interferon α5 (SEQ ID No.:1495), [D108N, E138T]interferon α5 (SEQ ID No.:1496), [D31N, D102N, D108N]interferon α5 (SEQ ID No.:1497), [D31N, D102N, E138T]interferon α5 (SEQ ID No.:1498), [D31N, D108N, E138T]interferon α5 (SEQ ID No.:1499), [D102N, D108N, E138T]interferon α5 (SEQ ID No.:1500), and [D31N, D102N, D108N, E138T]interferon α5 (SEQ ID No.:1501).

In another aspect, the following non-limiting list of hyperglycosylated variants of IFN-α6 are described: [D31N]interferon α6 (SEQ ID No.:1503), [D102N]interferon α6 (SEQ ID No.:1504), [D108N]interferon α6 (SEQ ID No.:1505), [G138T]interferon α6 (SEQ ID No.:1506), [D31N, D102N] interferon α6 (SEQ ID No.:1507), [D31N, D108N]interferon α6 (SEQ ID No.:1508), [D31N, G138T]interferon α6 (SEQ ID No.:1509), [D102N, D108N]interferon α6 (SEQ ID No.: 1510), [D102N, G138T]interferon α6 (SEQ ID No.:1511), [D108N, E138T]interferon α6 (SEQ ID No.:1512), [D31N, D102N, D108N]interferon α6 (SEQ ID No.:1513), [D31N, D102N, G138T]interferon α6 (SEQ ID No.:1514), [D31N, D108N, G138T]interferon α6 (SEQ ID No.:1515), [D102N, D108N, G138T]interferon α6 (SEQ ID No.:1516), and [D31N, D102N, D108N, G138T]interferon α6 (SEQ ID No.: 1517).

In another aspect, the following non-limiting list of hyperglycosylated variants of IFN-α7 are described: [D31N]interferon α7 (SEQ ID No.:1519), [D102N]interferon α7 (SEQ ID No.:1520), [E108N]interferon α7 (SEQ ID No.:1521), [E138T]interferon α7 (SEQ ID No.:1522), [D31N, D102N] interferon α7 (SEQ ID No.:1523), [D31N, E108N]interferon α7 (SEQ ID No.:1524), [D31N, E138T]interferon α7 (SEQ ID No.:1525), [D102N, E108N]interferon α7 (SEQ ID No.: 1526), [D102N, E138T]interferon α7 (SEQ ID No.:1527), [D108N, E138T]interferon α7 (SEQ ID No.:1528), [D31N, D102N, E108N]interferon α7 (SEQ ID No.:1529), [D31N, D102N, E138T]interferon α7 (SEQ ID No.:1530), [D31N, E108N, E138T]interferon α7 (SEQ ID No.:1531), [D102N, E108N, E138T]interferon α7 (SEQ ID No.:1532), and [D31N, D102N, E108N, E138T]interferon α7 (SEQ ID No.: 1533).

In another aspect, the following non-limiting list of hyperglycosylated variants of IFN-α8 are described: [D31N]interferon α8 (SEQ ID No.:1535), [D 102N]interferon α8 (SEQ ID No.:1536), [D108N]interferon α8 (SEQ ID No.:1537), [I138T]interferon α8 (SEQ ID No.:1538), [D31N, D102N] interferon α8 (SEQ ID No.:1539), [D31N, D108N]interferon α8 (SEQ ID No.:1540), [D31N, I138T]interferon α8 (SEQ ID No.:1541), [D102N, D108N]interferon α8 (SEQ ID No.: 1542), [D102N, I138T]interferon α8 (SEQ ID No.:1543), [D108N, I138T]interferon α8 (SEQ ID No.:1544), [D31N, D102N, D108N]interferon α8 (SEQ ID No.:1545), [D31N, D102N, I138T]interferon α8 (SEQ ID No.:1546), [D31N, D108N, I138T]interferon α8 (SEQ ID No.:1547), [D102N, D108N, I138T]interferon α8 (SEQ ID No.:1548), and [D31N, D102N, D108N, I138T]interferon α8 (SEQ ID No.: 1549).

In another aspect, the following non-limiting list of hyperglycosylated variants of IFN-α10 are described: [D31N]interferon α10 (SEQ ID No.:1551), [D102N]interferon 10 (SEQ ID No.:1552), [E108N]interferon α10 (SEQ ID No.: 1553), [E138T]interferon α10 (SEQ ID No.:1554), [D31N, D102N]interferon α10 (SEQ ID No.:1555), [D31N, E108N] interferon α10 (SEQ ID No.:1556), [D31N, E138T]interferon α10 (SEQ ID No.:1557), [D102N, E108N]interferon α10 (SEQ ID No.:1558), [D102N, E138T]interferon α10 (SEQ ID No.:1559), [D108N, E138T]interferon α10 (SEQ ID No.:1560), [D31N, D102N, E108N]interferon α10 (SEQ ID No.:1561), [D31N, D102N, E138T]interferon α10 (SEQ ID No.:1562), [D31N, E108N, E138T]interferon α10 (SEQ ID No.:1563), [D102N, E108N, E138T]interferon α10 (SEQ ID No.:1564), and [D31N, D102N, E108N, E138T]interferon α10 (SEQ ID No.:1565).

In another aspect, the following non-limiting list of hyperglycosylated variants of IFN-α13 are described: [D31N]interferon α13 (SEQ ID No.:1567), [D102N]interferon α13 (SEQ ID No.:1568), [D108N]interferon α13 (SEQ ID No.: 1569), [G138T]interferon α13 (SEQ ID No.:1570), [D31N, D102N]interferon α13 (SEQ ID No.:1571), [D31N, D108N] interferon α13 (SEQ ID No.:1572), [D31N, G138T]interferon α13 (SEQ ID No.:1573), [D102N, D108N]interferon α13 (SEQ ID No.:1574), [D102N, G138T]interferon α13 (SEQ ID No.:1575), [D108N, E138T]interferon α13 (SEQ ID No.:1576), [D31N, D102N, D108N]interferon α13 (SEQ ID No.:1577), [D31N, D102N, G138T]interferon α13 (SEQ ID No.:1578), [D31N, D108N, G138T]interferon α13 (SEQ ID No.:1579), [D102N, D108N, G138T]interferon α13 (SEQ ID No.:1580), and [D31N, D102N, D108N, G138T]interferon α13 (SEQ ID No.:1581).

In another aspect, the following non-limiting list of hyperglycosylated variants of IFN-α14 are described: [D108N] interferon α14 (SEQ ID No.:1585), [E138T]interferon α14 (SEQ ID No.:1586), and [D108N, E138T]interferon α14 (SEQ ID No.:1592).

In another aspect, the following non-limiting list of hyperglycosylated variants of IFN-α16 are described: [D31N]interferon α16 (SEQ ID No.:1599), [D102N]interferon α16 (SEQ ID No.:1600), [D108N]interferon α16 (SEQ ID No.: 1601), [E138T]interferon α16 (SEQ ID No.:1602), [D31N, D102N]interferon α16 (SEQ ID No.:1603), [D31N, D108N] interferon α16 (SEQ ID No.:1604), [D31N, E138T]interferon α16 (SEQ ID No.:1605), [D102N, D108N]interferon α16 (SEQ ID No.:1606), [D102N, E138T]interferon α16 (SEQ ID No.:1607), [D108N, E138T]interferon α16 (SEQ ID No.:1608), [D31N, D102N, D108N]interferon α16 (SEQ ID No.:1609), [D31N, D102N, E138T]interferon α16 (SEQ ID No.:1610), [D31N, D108N, E138T]interferon α16 (SEQ ID No.:1611), [D102N, D108N, E138T]interferon α16 (SEQ ID No.:1612), and [D31N, D102N, D108N, E138T]interferon α16 (SEQ ID No.:1613).

In another aspect, the following non-limiting list of hyperglycosylated variants of IFN-α17 are described: [D31N]interferon α17 (SEQ ID No.:1615), [D102N]interferon α17 (SEQ ID No.:1616), [E108N]interferon α17 (SEQ ID No.: 1617), [E138T]interferon α17 (SEQ ID No.:1618), [D31N, D102N]interferon α17 (SEQ ID No.:1619), [D31N, E108N] interferon α17 (SEQ ID No.:1620), [D31N, E138T]interferon α17 (SEQ ID No.:1621), [D102N, E108N]interferon α17 (SEQ ID No.:1622), [D102N, E138T]interferon α17 (SEQ ID No.:1623), [D108N, E138T]interferon α17 (SEQ ID No.:1624), [D31N, D102N, E108N]interferon α17 (SEQ ID No.:1625), [D31N, D102N, E138T]interferon α17 (SEQ ID No.:1626), [D31N, E108N, E138T]interferon α17 (SEQ ID No.:1627), [D102N, E108N, E138T]interferon α17 (SEQ ID No.:1628), and [D31N, D102N, E108N, E138T]interferon α17 (SEQ ID No.:1629).

In another aspect, the following non-limiting list of hyperglycosylated variants of IFN-α21 are described: [D31N]interferon α21 (SEQ ID No.:1631), [D102N]interferon α21 (SEQ ID No.:1632), [E108N]interferon α21 (SEQ ID No.: 1633), [E138T]interferon α21 (SEQ ID No.:1634), [D31N, D102N]interferon α21 (SEQ ID No.:1635), [D31N, E108N] interferon α21 (SEQ ID No.:1636), [D31N, E138T]interferon α21 (SEQ ID No.:1637), [D102N, E108N]interferon α21 (SEQ ID No.:1638), [D102N, E138T]interferon α21 (SEQ ID No.:1639), [D108N, E138T]interferon α21 (SEQ ID No.:1640), [D31N, D102N, E108N]interferon α21 (SEQ ID No.:1641), [D31N, D102N, E138T]interferon α21 (SEQ ID No.:1642), [D31N, E108N, E138T]interferon α21 (SEQ ID No.:1643), [D102N, E108N, E138T]interferon α21 (SEQ ID No.:1644), and [D31N, D102N, E108N, E138T]interferon α21 (SEQ ID No.:1645).

In another aspect, the following non-limiting list of hyperglycosylated variants of IFN-αH are described: [D108N]interferon αH (SEQ ID No.:1649), [E138T]interferon αH (SEQ ID No.:1650), and [D108N, E138T]interferon αH (SEQ ID No.:1656).

In another aspect, the following non-limiting list of hyperglycosylated variants of IFN-αI are described: [D31N]interferon αI (SEQ ID No.:1663), [D102N]interferon αI (SEQ ID No.:1664), [E108N]interferon αI (SEQ ID No.:1665), [E138T]interferon αI (SEQ ID No.:1666), [D31N, D102N]interferon αI (SEQ ID No.:1667), [D31N, E108N]interferon αI (SEQ ID No.:1668), [D31N, E138T]interferon αI (SEQ ID No.:1669), [D102N, E108N]interferon αI (SEQ ID No.:1670), [D102N, E138T]interferon αI (SEQ ID No.:1671), [D108N, E138T]interferon αI (SEQ ID No.:1672), [D31N, D102N, E108N]interferon αI (SEQ ID No.:1673), [D31N, D102N, E138T]interferon αI (SEQ ID No.:1674), [D31N, E108N, E138T]interferon αI (SEQ ID No.:1675), [D102N, E108N, E138T]interferon αI (SEQ ID No.:1676), and [D31N, D102N, E108N, E138T]interferon αI (SEQ ID No.:1677).

In another aspect, the following non-limiting list of hyperglycosylated variants of IFN-αJ1 are described: [D31N]interferon αJ1 (SEQ ID No.:1679), [D102N]interferon αJ1 (SEQ ID No.:1680), [E108N]interferon αJ1 (SEQ ID No.:1681), [E138T]interferon αJ1 (SEQ ID No.:1682), [D31N, D102N]interferon αJ1 (SEQ ID No.:1683), [D31N, E108N]interferon αJ1 (SEQ ID No.:1684), [D31N, E138T]interferon αJ1 (SEQ ID No.:1685), [D102N, E108N]interferon αJ1 (SEQ ID No.:1686), [D102N, E138T]interferon αJ1 (SEQ ID No.:1687), [D108N, E138T]interferon αJ1 (SEQ ID No.:1688), [D31N, D102N, E108N]interferon αJ1 (SEQ ID No.:1689), [D31N, D102N, E138T]interferon αJ1 (SEQ ID No.:1690), [D31N, E108N, E138T]interferon αJ1 (SEQ ID No.:1691), [D102N, E108N, E138T]interferon αJ1 (SEQ ID No.:1692), and [D31N, D102N, E108N, E138T]interferon αJ1 (SEQ ID No.:1693).

Suitable alpha interferons further include consensus IFN-α. Consensus IFN-α (also referred to as "CIFN" and "IFN-con" and "consensus interferon") encompasses but is not limited to the amino acid sequences designated IFN-con$_1$, IFN-con$_2$ and IFN-con$_3$ which are disclosed in U.S. Pat. Nos. 4,695,623 and 4,897,471; and consensus interferon as defined by determination of a consensus sequence of naturally occurring interferon alphas (e.g., Infergen®, InterMune, Inc., Brisbane, Calif.). IFN-con$_1$ is the consensus interferon agent in the Infergen® alfacon-1 product. The Infergen® consensus interferon product is referred to herein by its brand name (Infergen®) or by its generic name (interferon alfacon-1).

Suitable hyperglycosylated or protease-resistant, hyperglycosylated polypeptide variants include hyperglycosylated forms of any parent consensus IFN-α polypeptide; where the variant lacks at least one protease cleavage site found in the parent protein. In one aspect, a hyperglycosylated or protease-resistant, hyperglycosylated variant of a parent consensus IFN-α polypeptide has an amino acid sequence that differs from the amino acid sequence of the parent polypeptide to the extent that the variant comprises one or more glycosylation sites not found in a parent polypeptide; and where the variant comprises at least one mutated protease cleavage site in place of a native protease cleavage site found in the parent protein.

In another aspect, the parent polypeptide is the interferon alfacon-1 polypeptide and the hyperglycosylated or protease-resistant, hyperglycosylated polypeptide variant is an [D102N] interferon alfacon-1 glycopeptide, where the [D102N] interferon alfacon-1 glycopeptide is a variant of the interferon alfacon-1 polypeptide having (a) an asparagine residue substituted for the native aspartic acid residue at amino acid position 102, which corresponds to amino acid position 99 in the amino acid sequence of Infergen (interferon alfacon-1) depicted in FIG. 24 and (b) a carbohydrate moiety covalently attached to the R-group of said asparagine residue.

In another aspect, the parent polypeptide is the interferon alfacon-1 polypeptide and the hyperglycosylated or protease-resistant, hyperglycosylated polypeptide variant is an [D102N, D108N]interferon alfacon-1 glycopeptide, where the [D102N, D108N]interferon alfacon-1 glycopeptide is a variant of the interferon alfacon-1 polypeptide having (a) an asparagine residue substituted for each of the native aspartic acid residues at amino acid positions 102 and 108, which correspond to amino acid positions 99 and 105 in the amino acid sequence of Infergen depicted in FIG. 24 and (b) a carbohydrate moiety covalently attached to the R-group of each of said asparagine residues.

In another aspect, the parent polypeptide is the interferon alfacon-1 polypeptide and the hyperglycosylated or protease-resistant, hyperglycosylated polypeptide variant is an [D102N, D108N, E138N]interferon alfacon-1 glycopeptide, where the [D102N, D108N, E138N]interferon alfacon-1 glycopeptide is a variant of the interferon alfacon-1 polypeptide having (a) an asparagine residue substituted for each of the native aspartic acid, aspartic acid, and glutamic acid residues at amino acid positions 102, 108 and 138, which correspond to amino acid positions 99, 105 and 134, respectively, in the amino acid sequence of Infergen depicted in FIG. 24 and (b) a carbohydrate moiety covalently attached to the R-group of each of said asparagine residues.

In another aspect, the parent polypeptide is the interferon alfacon-1 polypeptide and the hyperglycosylated or protease-resistant, hyperglycosylated polypeptide variant is an [D102N, E138N]interferon alfacon-1 glycopeptide, where the [D102N, E138N] interferon alfacon-1 glycopeptide is a variant of the interferon alfacon-1 polypeptide having (a) an asparagine residue substituted for each of the native aspartic acid and glutamic acid residues at amino acid positions 102 and 138, which correspond to amino acid positions 99 and 134, respectively, in the amino acid sequence of Infergen depicted in FIG. 24 and (b) a carbohydrate moiety covalently attached to the R-group of each of said asparagine residues.

In another aspect, the parent polypeptide is the interferon alfacon-1 polypeptide and the hyperglycosylated or protease-resistant, hyperglycosylated polypeptide variant is an [D108N, E138N]interferon alfacon-1 glycopeptide, where the [D108N, E138N] interferon alfacon-1 glycopeptide is a variant of the interferon alfacon-1 polypeptide having (a) an asparagine residue substituted for each of the native aspartic acid and glutamic acid residues at amino acid positions 108 and 138, which correspond to amino acid positions 105 and 134, respectively, in the amino acid sequence of Infergen depicted in FIG. 24 and (b) a carbohydrate moiety covalently attached to the R-group of each of said asparagine residues.

In another aspect, the parent polypeptide is the interferon alfacon-1 polypeptide and the hyperglycosylated or protease-resistant, hyperglycosylated polypeptide variant is an [D102N, D108N, E138T]interferon alfacon-1 glycopeptide, where the [D102N, D108N, E138T]interferon alfacon-1 glycopeptide is a variant of the interferon alfacon-1 polypeptide having (a) an asparagine residue substituted for each of the native aspartic acid residues at amino acid positions 102 and 108 in the amino acid sequence of Infergen which correspond to amino acid positions 99 and 105, respectively, in the amino acid sequence of Infergen depicted in FIG. 24 (b) a threonine residue substituted for the native glutamic acid residue at amino acid position 138, which corresponds to amino acid position 134 in the amino acid sequence of Infergen depicted in FIG. 24 and (c) a carbohydrate moiety covalently attached to the R-group of each of said asparagine and threonine residues.

In another aspect, the parent polypeptide is the interferon alfacon-1 polypeptide and the hyperglycosylated or protease-resistant, hyperglycosylated polypeptide variant is an [D102N, E138T]interferon alfacon-1 glycopeptide, where the [D102N, E138T] interferon alfacon-1 glycopeptide is a variant of the interferon alfacon-1 polypeptide having (a) an asparagine residue substituted for the native aspartic acid residue at amino acid position 102, which corresponds to amino acid position 99 in the amino acid sequence of Infergen depicted in FIG. 24 (b) a threonine residue substituted for the native glutamic acid residue at amino acid position 138, which corresponds to amino acid position 134 in the amino acid sequence of Infergen depicted in FIG. 24 and (c) a carbohydrate moiety covalently attached to the R-group of each of said asparagine and threonine residues.

In another aspect, the parent polypeptide is the interferon alfacon-1 polypeptide and the hyperglycosylated or protease-resistant, hyperglycosylated polypeptide variant is an [D108N, E138T]interferon alfacon-1 glycopeptide, where the [D108N, E138T]interferon alfacon-1 glycopeptide is a variant of the interferon alfacon-1 polypeptide having (a) an asparagine residue substituted for the native aspartic acid residue at amino acid position 108, which corresponds to amino acid position 105 in the amino acid sequence of Infergen depicted in FIG. 24 (b) a threonine residue substituted for the native glutamic acid residue at amino acid position 138, which corresponds to amino acid position 134 in the amino acid sequence of Infergen depicted in FIG. 24 and (c) a carbohydrate moiety covalently attached to the R-group of each of said asparagine and threonine residues.

The numbering of amino acids, discussed in the context of amino acid replacements for generating hyperglycosylation variants of the parent protein therapeutic, coincides with the numbering of amino acids used to depict the Type I interferon amino acid sequences appearing in FIG. 24. In the context of amino acid replacements, for generating protease-resistant variants of the parent protein therapeutic, the numbering of amino acids used to describe IFN-α variants coincides with the numbering of amino acids as depicted in FIG. 24.

FIG. 34 shows the amino acid sequence alignment of the human type I interferon (IFN) precursors and the fusion protein of consensus IFN-αCon1 with human IFN α14 signal peptide (Infergen w A14 Sig.). All the human type I IFN precursors are naturally occurring and have signal peptides to direct their translocation through the cell membranes for secretion. Infergen is a bio-engineered interferon based on the consensus amino acid sequences of different subtypes of human Interferon α. It is produced in *E. coli* and does not have a signal peptide. For expression in mammalian cells, the signal peptide of human IFN α14 is attached to the N-terminal of Infergen to direct its secretion. However the signal peptides from other human type I IFNs or even other human or animal proteins could be used for this purpose as well.

This figure shows the consensus sequence from the alignment as "Majority" sequence and a ruler below the consensus sequence for aligning all of the sequences. The actual amino acid residue numbers for the species are shown at the left hand side of each sequence. Please note that the numbers shown on the ruler are different from actual residue numbers for the species.

Because there are high sequence homologies among these listed species, the alignment was used to "rationally" design the glycosylation sites in the species based on the position of the naturally occurring glycosylation sites in certain homologous species in the alignment. To uniformly identify the positions of the glycosylation sites in the alignment, the numbering system of the ruler is used in positioning the mutants. The first potential glycosylation site is an N-linked glycosylation site in human IFN α14 and H at position 31 in ruler. The consensus recognition site of N-linked glycosylation is Asn_X_Ser/Thr with Asn be the residue where carbohydrate chain attaches. In order to create a glycosylation site at position 31 in the ruler for other species, residues at position 31 in the ruler throughout the species will needed to be changed to Asn and the residues at position 33 changed to either Ser or Thr. The site of this glycosylation will all be numbered 31 throughout the species but the actual amino acid residue number will vary from one species to another. The glycosylation site 31 is actually at amino acid number 25 for all of the species in FIG. 34 except IFN κ in which it is number 31. Human IFN α14 and H also have a naturally occurring glycosylation site at position 102 in the ruler and thus this glycosylation site will be numbered 102 throughout the species. However position 102 is at the actual amino acid number 94 in IFN α2a and IFN αb; at the actual amino acid number 95 in IFN α 1, 4a, 4b, 5, 6, 7, 8, 10, 13, 14, 16, 17, 21, H, I, J1, IFN β1, IFN ω1 and Infergen with signal peptide; at the actual amino acid 96 in IFN τ and at actual amino acid number 102 in IFN κ. Human IFN β1 and ω1 have a naturally occurring glycosylation site at position 108 in the ruler and thus this glycosylation site will be numbered 108 throughout the species. However position 108 is at the actual amino acid number 100 in IFN α2a and IFN α2b; at actual amino acid number 101 in IFN α1, 4a, 4b, 5, 6, 7, 8, 10, 13, 14, 16, 17, 21, H, I, J1, IFN β1, IFN ω1 and Infergen with signal peptide; at actual amino acid number 107 in IFN κ and at actual amino acid number 102 in IFN τ. Human IFN α 2b has a naturally occurring O-linked glycosylation site at position 138 in the ruler and thus this glycosylation site will be numbered 138 throughout the species. However position 138 is at the actual amino acid number 129 in IFN α2a and IFN α2b, at actual amino acid number 130 in IFN α1, 4a, 4b, 5, 6, 7, 8, 10, 13, 14, 16, 17, 21, H, I, J1, IFN β1, IFN ω1 and Infergen with signal peptide; at actual amino acid number 137 in IFN κ and at actual amino acid number 129 in IFN τ.

In another aspect, a hyperglycosylated or protease-resistant, hyperglycosylated polypeptide variant of a parent interferon-alpha therapeutic differs from the parent interferon-alpha therapeutic to the extent that the hyperglycosylated or protease-resistant, hyperglycosylated polypeptide variant comprises (1) a carbohydrate moiety covalently attached to a non-native glycosylation site not found in the parent interferon-alpha therapeutic and/or (2) a carbohydrate moiety covalently attached to a native glycosylation site found but not glycosylated in the parent interferon-alpha therapeutic; and comprises at least one mutated protease cleavage site in place of a native protease cleavage site found in the parent IFN-α protein therapeutic.

IFN-β

The amino acid sequence of any known IFN-β can be modified to generate a subject synthetic Type I interferon receptor polypeptide agonist. The term interferon-beta ("IFN-β") includes IFN-β polypeptides that are naturally occurring; and non-naturally-occurring IFN-β polypeptides. Suitable beta interferons include, but are not limited to, naturally-occurring IFN-β; IFN-β1a, e.g., Avonex® (Biogen, Inc.), and Rebif® (Serono, S A); IFN-β1b (Betaseron®; Berlex); and the like. Amino acid sequences of IFN-β are publicly available; for example, human IFN-β1 amino acid sequence is found under GenBank Accession No. NP_002167 and is depicted in FIG. 24 (SEQ ID NO:1359). A human IFN-β amino acid sequence is also depicted in FIG. 3.

Suitable hyperglycosylated or protease-resistant, hyperglycosylated polypeptide variants include hyperglycosylated forms of any parent IFN-β polypeptide. In one aspect, a hyperglycosylated or protease-resistant, hyperglycosylated variant of a parent IFN-β polypeptide has an amino acid sequence that differs from the amino acid sequence of the parent polypeptide to the extent that the variant comprises one or more glycosylation sites not found in the parent polypeptide; and comprises at least one mutated protease cleavage site in place of a native protease cleavage site found in the parent IFN-β polypeptide.

The numbering of amino acids, discussed in the context of amino acid replacements for generating hyperglycosylation variants of the parent protein therapeutic, coincides with the numbering of amino acids used to depict the Type I interferon amino acid sequences appearing in FIG. 24. In the context of amino acid replacements, for generating protease-resistant variants of the parent protein therapeutic, the numbering of amino acids used to describe IFN-β variants coincides with the numbering of amino acids as depicted in FIG. 24.

In another aspect, a hyperglycosylated or protease-resistant, hyperglycosylated polypeptide variant of a parent interferon-beta therapeutic differs from the parent interferon-beta therapeutic to the extent that the protease-resistant or protease-resistant, hyperglycosylated polypeptide variant comprises (1) a carbohydrate moiety covalently attached to a non-native glycosylation site not found in the parent interferon-beta therapeutic and/or (2) a carbohydrate moiety covalently attached to a native glycosylation site found but not glycosylated in the parent interferon-beta therapeutic; and comprises at least one mutated protease cleavage site in place of a native protease cleavage site found in the parent IFN-β polypeptide.

In another aspect, the following non-limiting list of hyperglycosylated variants of IFN-β are described: [L31S]interferon-β (SEQ ID No.:1695), [S102N]interferon-β (SEQ ID No.:1696), [E138T]interferon-β (SEQ ID No.:1698), [L31S, S102N]interferon-β (SEQ ID No.:1699), [L31S, E138T]interferon-β (SEQ ID No.:1701), [S102N, E138T]interferon-β (SEQ ID No.:1703), and [L31S, S102N, E138T]interferon-β (SEQ ID No.:1706).

IFN-tau

The amino acid sequence of any known IFN-tau can be modified to generate a subject synthetic Type I interferon receptor polypeptide agonist. The term interferon-tau includes IFN-tau polypeptides that are naturally occurring; and non-naturally-occurring IFN-tau polypeptides Suitable tau interferons include, but are not limited to, naturally-occurring IFN-tau; Tauferon® (Pepgen Corp.); and the like. IFN-tau may comprise an amino acid sequence as set forth in any one of GenBank Accession Nos. P115696; P56828; P56832; P56829; P56831; Q29429; Q28595; Q28594; S08072; Q08071; Q08070; Q08053; P56830; P28169; P28172; and P28171. Any hyperglycosylated or protease-resistant, hyperglycosylated IFN-tau polypeptide variant that retains a desired pharmacologic activity of IFN-tau may be used in the methods or compositions of the invention.

Suitable hyperglycosylated or protease-resistant, hyperglycosylated polypeptide variants include protease-resistant or protease-resistant, hyperglycosylated forms of any parent IFN-tau polypeptide. In one aspect, a hyperglycosylated variant of a parent IFN-tau polypeptide has an amino acid sequence that differs from the amino acid sequence of the parent polypeptide to the extent that the variant comprises one or more glycosylation sites not found in the parent polypeptide. In one aspect, a protease-resistant, hyperglycosylated polypeptide variant of a parent IFN-tau polypeptide has an amino acid sequence that differs from the amino acid sequence of the parent polypeptide to the extent that the variant comprises one or more glycosylation sites not found in the parent polypeptide and at least one mutated protease cleavage site in place of a native protease cleavage site found in a parent IFN-tau polypeptide.

In another aspect, the following non-limiting list of hyperglycosylated variants of IFN-τ are described: [K31N]interferon τ (SEQ ID No.:1743), [I102N]interferon τ (SEQ ID No.:1744), [E108N]interferon τ (SEQ ID No.:1745), [L138T]interferon τ (SEQ ID No.:1746), [K31N, I102N] interferon τ (SEQ ID No.:1747), [K31N, E108N]interferon τ (SEQ ID No.:1748), [K31N, L138T]interferon τ (SEQ ID No.:1749), [I102N, E108N]interferon τ (SEQ ID No.:1750), [I102N, L138T]interferon τ (SEQ ID No.:1751), [E108N, L138T]interferon τ (SEQ ID No.:1752), [K31N, I102N, E108N]interferon τ (SEQ ID No.:1753), [K31N, I102N, L138T]interferon τ (SEQ ID No.:1754), [K31N, E108N, L138T]interferon τ (SEQ ID No.:1755), [I102N, E108N, L138T]interferon τ (SEQ ID No.:1756), and [K31N, I102N, E108N, L138T]interferon T (SEQ ID No.:1757).

IFN-ω

The amino acid sequence of any known IFN-omega can be modified to generate a subject synthetic Type I interferon receptor polypeptide agonist. The term interferon-omega ("IFN-ω") includes IFN-ω polypeptides that are naturally occurring; and non-naturally-occurring IFN-ω polypeptides. Suitable IFN-β include, but are not limited to, naturally-occurring IFN-ω; recombinant IFN-ω, e.g., Biomed 510 (BioMedicines); and the like. IFN-ω may comprise an amino acid sequence as set forth in GenBank Accession No. NP_002168; or AAA70091.

Suitable hyperglycosylated or protease-resistant, hyperglycosylated polypeptide variants include protease-resistant or protease-resistant, hyperglycosylated forms of any parent IFN-ω polypeptide. In one aspect, a hyperglycosylated or protease-resistant, hyperglycosylated variant of a parent IFN-ω polypeptide has an amino acid sequence that differs from the amino acid sequence of the parent polypeptide to the extent that the variant comprises one or more glycosylation sites not found in the parent polypeptide; and comprises at least one mutated protease cleavage site in place of a native protease cleavage site found in the parent polypeptide.

In another aspect, the parent polypeptide is IFN-ω1 and the hyperglycosylated or protease-resistant, hyperglycosylated polypeptide variant is an [R102N]IFN-ω1 glycopeptide, where the [R102N]IFN-ω1 glycopeptide is a variant of IFN-α1 having (a) an asparagine residue substituted for the native arginine residue at amino acid position 102 in the amino acid sequence of IFN-ω1 and (b) a carbohydrate moiety covalently attached to the R-group of said asparagine residue; where the variant comprises at least one mutated protease cleavage site in place of a native protease cleavage iste found in the parent polypeptide.

In another aspect, the parent polypeptide is IFN-ω1 and the hyperglycosylated or protease-resistant, hyperglycosylated polypeptide variant is an [G138N]IFN-ω1 glycopeptide, where the [G138N]IFN-ω1 glycopeptide is a variant of IFN-ω1 having (a) an asparagine residue substituted for the native glycine residue at amino acid position 138 in the amino acid sequence of IFN-ω1 and (b) a carbohydrate moiety covalently attached to the R-group of said asparagine residue; where the variant comprises at least one mutated protease cleavage site in place of a native protease cleavage site found in the parent polypeptide.

In another aspect, the parent polypeptide is IFN-ω1 and the hyperglycosylated or protease-resistant, hyperglycosylated polypeptide variant is an [G138T]IFN-ω1 glycopeptide, where the [G138T]IFN-ω1 glycopeptide is a variant of IFN-ω1 having (a) an threonine residue substituted for the native glycine residue at amino acid position 138 in the amino acid sequence of IFN-ω1 and (b) a carbohydrate moiety covalently attached to the R-group of said threonine residue; where the variant comprises at least one mutated protease cleavage site in place of a native protease cleavage site found in the parent polypeptide.

In another aspect, the parent polypeptide is IFN-ω1 and the hyperglycosylated or protease-resistant, hyperglycosylated polypeptide variant is an [S102N, G138N]IFN-ω1 glycopeptide, where the [S102N, G138N]IFN-ω1 glycopeptide is a variant of IFN-ω1 having (a) asparagine residues substituted for the native serine and glycine residues at amino acid positions 102 and 138, respectively, in the amino acid sequence of IFN-ω1 and (b) a carbohydrate moiety covalently attached to the R-group of each of said asparagine residues; where the variant comprises at least one mutated protease cleavage site in place of a native protease cleavage site found in the parent polypeptide.

In another aspect, the parent polypeptide is IFN-ω1 and the hyperglycosylated or protease-resistant, hyperglycosylated polypeptide variant is an [S102N, G138T]IFN-ω1 glycopeptide, where the [S102N, G138T]IFN-ω1 glycopeptide is a variant of IFN-ω1 having (a) asparagine and threonine residues substituted for the native serine and glycine residues at amino acid positions 102 and 138, respectively, in the amino acid sequence of IFN-ω1 (as set forth in FIG. 24) and (b) a carbohydrate moiety covalently attached to the R-group of each of said asparagine and threonine residue; where the variant comprises at least one mutated protease cleavage site in place of a native protease cleavage site found in the parent polypeptide.

In another aspect, several variants of interferon-ω are described. By means of non-limiting example, [D31N]interferon co (SEQ ID No.:1727), [R102N]interferon co (SEQ ID No.:1728), [G138T]interferon co (SEQ ID No.:1730), [D31N, R102N]interferon co (SEQ ID No.:1731), [D31N, G138T]interferon co (SEQ ID No.:1733), [R102N, G138T] interferon co (SEQ ID No.:1735), [D31N, R102N, G138T] interferon Co (SEQ ID No.:1738).

The numbering of amino acids, discussed in the context of amino acid replacements for generating hyperglycosylation variants of the parent protein therapeutic, coincides with the numbering of amino acids used to depict the Type I interferon amino acid sequences appearing in FIG. 24. In the context of amino acid replacements, for generating protease-resistant variants of the parent protein therapeutic, the numbering of amino acids used to describe IFN-omega variants coincides with the numbering of amino acids as depicted in FIG. 24.

In another aspect, a hyperglycosylated or protease-resistant, hyperglycosylated polypeptide variant of a parent interferon-omega therapeutic differs from the parent interferon-omega therapeutic to the extent that the hyperglycosylated or protease-resistant, hyperglycosylated polypeptide variant comprises (1) a carbohydrate moiety covalently attached to a non-native glycosylation site not found in the parent interferon-omega therapeutic and/or (2) a carbohydrate moiety covalently attached to a native glycosylation site found but not glycosylated in the parent interferon-omega therapeutic; and comprises at least one mutated protease cleavage site in place of a native protease cleavage site found in the parent polypeptide.

Interferon-Kappa

The amino acid sequence of any known IFN-kappa can be modified to generate a subject synthetic Type I interferon receptor polypeptide agonist. The term interferon-kappa includes IFN-kappa polypeptides that are naturally occurring; and non-naturally-occurring IFN-kappa polypeptides. Suitable kappa interferons include, but are not limited to, naturally-occurring IFN-kappa and the like. IFN-kappa may comprise an amino acid sequence as set forth in any one of GenBank Accession No. NM_020124. Any hyperglycosylated or protease-resistant, hyperglycosylated IFN-kappa polypeptide variant that retains a desired pharmacologic activity of IFN-kappa may be used in the methods or compositions of the invention.

Suitable hyperglycosylated or protease-resistant, hyperglycosylated polypeptide variants include protease-resistant or protease-resistant, hyperglycosylated forms of any parent IFN-kappa polypeptide. In one aspect, a hyperglycosylated variant of a parent IFN-kappa polypeptide has an amino acid sequence that differs from the amino acid sequence of the parent polypeptide to the extent that the variant comprises one or more glycosylation sites not found in the parent polypeptide. In one aspect, a protease-resistant, hyperglycosylated polypeptide variant of a parent IFN-kappa polypeptide has an amino acid sequence that differs from the amino acid sequence of the parent polypeptide to the extent that the variant comprises one or more glycosylation sites not found in the parent polypeptide and at least one mutated protease cleavage site in place of a native protease cleavage site found in a parent IFN-kappa polypeptide.

In another aspect, the following non-limiting list of hyperglycosylated variants of IFN-κ are described: [L31S]interferon κ (SEQ ID No.:1711), [T102N]interferon κ (SEQ ID No.:1712), [K108N]interferon κ (SEQ ID No.:1713), [P138T]interferon κ (SEQ ID No.:1714), [L31S, T102N] interferon κ (SEQ ID No.:1715), [L31S, K108N]interferon κ (SEQ ID No.:1716), [L31S, P138T]interferon κ (SEQ ID No.:1717), [T102N, K108N]interferon κ (SEQ ID No.: 1718), [T102N, P138T]interferon κ (SEQ ID No.:1719), [K108N, P138T]interferon κ (SEQ ID No.:1720), [L31S, T102N, K108N]interferon κ (SEQ ID No.:1721), [L31S, T102N, P138T]interferon κ (SEQ ID No.:1722), [L31S, K108N, P138T]interferon κ (SEQ ID No.:1723), [T102N, K108N, P138T]interferon κ (SEQ ID No.:1724), and [L31S, T102N, K108N, P138T]interferon κ (SEQ ID No.:1725).

Interferon-Gamma

The nucleic acid sequences encoding IFN-γ polypeptides may be accessed from public databases, e.g., GenBank, journal publications, and the like. While various mammalian IFN-gamma polypeptides are of interest, for the treatment of human disease, generally the human protein will be used. Human IFN-gamma coding sequence may be found in Genbank, accession numbers X13274; V00543; and NM_000619. The corresponding genomic sequence may be found in Genbank, accession numbers J00219; M37265; and V00536. See, for example. Gray et al. (1982) *Nature* 295:501 (Genbank X13274); and Rinderknecht et al. (1984) *J.B.C.* 259:6790. In some embodiments, the IFN-γ is glycosylated.

IFN-γ1b (Actimmune®; human interferon) is a single-chain polypeptide of 140 amino acids. It is made recombinantly in *E. coli* and is unglycosylated (Rinderknecht et al.

1984, *J. Biol. Chem.* 259:6790-6797). Recombinant IFN-gamma as discussed in U.S. Pat. No. 6,497,871 is also suitable for use herein.

The term "IFN-gamma" includes any of natural IFN-gamma, recombinant IFN-gamma and the derivatives thereof so far as they have an IFN-γ activity, particularly human IFN-gamma activity. Human IFN-gamma exhibits the antiviral and anti-proliferative properties characteristic of the interferons, as well as a number of other immunomodulatory activities, as is known in the art. Although IFN-gamma is based on the sequences as provided above, the production of the protein and proteolytic processing can result in processing variants thereof. The unprocessed sequence provided by Gray et al., supra, consists of 166 amino acids (aa). Although the recombinant IFN-gamma produced in *E. coli* was originally believed to be 146 amino acids, (commencing at amino acid 20) it was subsequently found that native human IFN-gamma is cleaved after residue 23, to produce a 143 aa protein, or 144 aa if the terminal methionine is present, as required for expression in bacteria. During purification, the mature protein can additionally be cleaved at the C terminus after reside 162 (referring to the Gray et al. sequence), resulting in a protein of 139 amino acids, or 140 amino acids if the initial methionine is present, e.g. if required for bacterial expression. The N-terminal methionine is an artifact encoded by the mRNA translational "start" signal AUG that, in the particular case of *E. coli* expression is not processed away. In other microbial systems or eukaryotic expression systems, methionine may be removed.

Any of the native IFN-gamma peptides, modifications and variants thereof, or a combination of one or more peptides can serve as a parent polypeptide referent in connection with the present methods and/or compositions. IFN-gamma peptides of interest include fragments, and can be variously truncated at the carboxyl terminus relative to the full sequence. Such fragments continue to exhibit the characteristic properties of human gamma interferon, so long as amino acids 24 to about 149 (numbering from the residues of the unprocessed polypeptide) are present. Extraneous sequences can be substituted for the amino acid sequence following amino acid 155 without loss of activity. See, for example, U.S. Pat. No. 5,690,925. Native IFN-gamma moieties include molecules variously extending from amino acid residues 24-150; 24-151, 24-152; 24-153, 24-155; and 24-157.

Any hyperglycosylated or protease-resistant, hyperglycosylated IFN-gamma polypeptide variant that retains a desired pharmacologic activity of a parent IFN-gamma polypeptide may be used in the methods and/or compositions of the invention.

In another aspect, a hyperglycosylated or protease-resistant, hyperglycosylated polypeptide variant of a parent interferon-gamma therapeutic differs from the parent interferon-gamma therapeutic to the extent that the hyperglycosylated or protease-resistant, hyperglycosylated polypeptide variant comprises (1) a carbohydrate moiety covalently attached to a non-native glycosylation site not found in the parent interferon-gamma therapeutic and/or (2) a carbohydrate moiety covalently attached to a native glycosylation site found but not glycosylated in the parent interferon-gamma therapeutic; and comprises at least one mutated protease cleavage site in place of a native protease cleavage site found in the parent IFN-γ polypeptide.

In another aspect, the parent protein therapeutic is interferon gamma-1b and the hyperglycosylated or protease-resistant, hyperglycosylated polypeptide variant of the parent interferon gamma-1b therapeutic is a protease-resistant variant of glycosylated native (wild-type) human IFN-γ. Glycosylated native (wild-type) human IFN-γ is described in WO 02/081507.

Erythropoietin

In some embodiments, a hyperglycosylated or protease-resistant, hyperglycosylated polypeptide variant comprises an erythropoietin amino acid sequence comprising at least one non-native glycosylation site compared to a parent erythropoietin polypeptide; and comprises at least one mutated protease cleavage site in place of a native protease cleavage site found in the parent EPO polypeptide. Suitable erythropoietin polypeptides include those proteins that have the biological activity of human erythropoietin such as erythropoietin analogs; erythropoietin isoforms; erythropoietin fragments; hybrid erythropoietin proteins; fusion proteins; and oligomers and multimers of any of the foregoing.

Specific examples of erythropoietin include, but are not limited to, human erythropoietin (see, e.g., Jacobs et al. (1985) *Nature* 313:806-810; and Lin et al. (1985) *Proc Natl Acad Sci USA* 82:7580-7584); erythropoietin polypeptides discussed in U.S. Pat. Nos. 6,696,056 and 6,585,398; the amino acid sequences provided in GenBank Accession Nos. NP_00790 and CAA26095; Epoetin alfa (EPREX®; ERYPO®); Novel erythropoiesis stimulating protein (NESP) (a hyperglycosylated analog of recombinant human eryhropoietin (Epoetin) described in European patent application EP640619); human erythropoietin analog—human serum albumin fusion proteins described in International patent application WO10266054; erythropoietin mutants described in International patent application WO10238890; erythropoietin omega, which may be produced from an Apa I restriction fragment of the human erythropoietin gene described in U.S. Pat. No. 5,688,679; altered glycosylated human erythropoietin described in International patent application WO 10211781; PEG conjugated erythropoietin analogs described in WO9805363 or U.S. Pat. No. 5,643,575. Specific examples of cell lines modified for expression of endogenous human erythropoietin are described in international patent applications WO10205268 and WO9412650.

In one aspect, a hyperglycosylated or protease-resistant, hyperglycosylated variant of a parent erythropoietin polypeptide retains the hematopoietic activity of the parent erythropoietin as determined by monitoring and measurement of the patient's hematocrit.

In another aspect, the parent polypeptide is EPOGEN® epoetin alfa and the hyperglycosylated or protease-resistant, hyperglycosylated polypeptide variant is a protease-resistant variant of ARANESP® darbepoetin alfa.

Insulin

In some embodiments, a hyperglycosylated or protease-resistant, hyperglycosylated polypeptide variant comprises an insulin amino acid sequence comprising at least one non-native glycosylation site compared to a parent insulin polypeptide; and comprises at least one mutated protease cleavage site in place of a native protease cleavage site found in the parent insulin polypeptide. Suitable insulin polypeptides include, but are not limited to, proinsulin, preproinsulin, and the insulin forms disclosed in U.S. Pat. Nos. 4,1022,417; 4,1022,418; 5,474,978; 5,514,646; 5,504,188; 5,547,929; 5,650,486; 5,693,609; 5,700,662; 5,747,642; 5,922,675; 5,952,297; 6,034,054; and 6,211,144; and published PCT applications WO 00/121197; WO 09/010,645; and WO 90/12814. Insulin analogs include, but are not limited to, superactive insulin analogs, monomeric insulins, and hepatospecific insulin analogs. Various forms of insulin include Humalog®; Humalog® Mix 50/50™; Humalog®

Mix 75/25™; Humulin® 50/50; Humulin® 70/30; Humulin® L; Humulin® N; Humulin® R; Humulin® Ultralente; Lantus®; Lente® Iletin® II; Lente® Insulin; Lente® L; Novolin® 70/30; Novolin® L; Novolin® N; Novolin® R; NovoLog™; NPH Iletin® I; NPH-N; Pork NPH Ileting II; Pork Regular Iletin® II; Regular (Concentrated) Iletin® II U-500; Regular Iletin® I; and Velosulin® BR Human (Buffered).

Insulin polypeptides suitable for modification and use according to the present invention include analogs of human insulin wherein position B28 is Asp, Lys, Leu, Val or Ala and position B29 is Lys or Pro; des(B28-B30) human insulin; des(B27) human insulin; des(B30) human insulin; an analog of human insulin in which position B28 is Asp and position B29 is Lys or Pro; an analog of human insulin in which position B28 is Lys, and position B29 is Lys or Pro; $Asp^{B28}$ human insulin; $Lys^{B28} Pro^{B29}$ human insulin; B29-N$^\epsilon$-myristoyl-des(B30) human insulin; B29-N$^\epsilon$-palmitoyl-des(B30) human insulin; B29-N$^\epsilon$-myristoyl human insulin; B29-N$^\epsilon$-palmitoyl human insulin; B28-N$^\epsilon$-myristoyl $Lys^{B28} Pro^{B29}$ human insulin; B28-N$^\epsilon$-palmitoyl $Lyw^{B28} Pro^{B29}$ human insulin; B30-N$^\epsilon$-myristoyl $Thr^{B29} Lys^{B30}$ human insulin; B30-N$^\epsilon$-palmitoyl-$Thr^{B29} Lys^{B30}$ human insulin; B29-N$^\epsilon$-(N-palmitoyl-γ-glutamyl)-des(B30) human insulin; B29-N$^\epsilon$-(N-lithocholyl-γ-glutamyl)-des(B30) human insulin; B29-N'-(ω-carboxyheptadecanoyl)-des(B30) human insulin; and B29-N'-(ω-carboxyheptadecanoyl) human insulin.

The amino acid sequences of various insulin polypeptides are publicly available in, e.g., public databases such as GenBank, journal articles, patents and published patent applications, and the like. For example, the amino acid sequences of human insulin are found in GenBank under the following accession numbers: CAA00714; CAA00713; CAA00712; CAA01254; 1HISA and 1HISB; 1 HIQA and 1 HIQB; 1HITA and 1HITB; 1 HLSA and 1HLSB; 1VKTA and 1VKTB.

In addition, insulin derivatives and protease-resistant or protease-resistant, hyperglycosylated forms thereof can be used as parent polypeptides and hyperglycosylated or protease-resistant, hyperglycosylated polypeptide variants, respectively, in methods and/or compositions of the present invention. Insulin derivatives, include, but are not limited to, acylated insulin, glycosylated insulin, and the like. Examples of acylated insulin include those disclosed in U.S. Pat. No. 5,922,675, e.g., insulin derivatized with a $C_6$-$C_{21}$ fatty acid (e.g., myristic, pentadecylic, palmitic, heptadecylic, or stearic acid) at an α- or ε-amino acid of glycine, phenylalanine, or lysine.

Antibodies

In some embodiments, a hyperglycosylated or protease-resistant, hyperglycosylated polypeptide variant comprises an antibody polypeptide amino acid sequence, and further comprises at least one non-native glycosylation site compared to a parent antibody polypeptide; and further comprises at least one mutated protease cleavage site in place of a native protease cleavage site found in the parent polypeptide. Suitable antibodies include, but are not limited to, antibodies of various isotypes (e.g., IgG1, IgG3 and IgG4); monoclonal antibodies produced by any means; humanized antibodies; chimeric antibodies; single-chain antibodies; antibody fragments such as Fv, F(ab')$_2$, Fab', Fab, Facb, and the like; and the like, provided that the antibody is capable of binding to antigen. Suitable monoclonal antibodies include antibodies that are specific for a cell surface receptor and that function as antagonists to the receptor, including, but not limited to, antibody to TGF-β receptor, antibody to TNF-α receptor, antibody to VEGF receptor (see, e.g., U.S. Pat. Nos. 6,617, 160, 6,448,077, and 6,365,157), antibody to epidermal growth factor receptor, and the like; antibodies specific for receptor ligands, including, but not limited to, antibody to TGF-β, antibody to TNF-α, antibody to VEGF, and the like; antibody specific for a tumor-associated antigen; antibody specific for CD20; antibody specific for epidermal growth factor receptor-2; antibody specific for the receptor binding domain of IgE; antibody specific for adhesion molecules (e.g., antibody specific for α subunit (CD11a) of LFA-1; antibody specific for α4β7; etc.); and the like.

Blood Factors

In some embodiments, a hyperglycosylated or protease-resistant, hyperglycosylated polypeptide variant comprises a blood factor polypeptide amino acid sequence, and further comprises at least one non-native glycosylation site compared to a parent blood factor polypeptide; and comprises at least one mutated protease cleavage site in place of a native protease cleavage site found in a parent polypeptide. Suitable blood factor polypeptides include, but are not limited to, a tissue plasminogen activator (TPA); Factor VIIa; Factor VIII; Factor IX; β-globin; hemoglobin; and the like. The amino acid sequences of various blood factors are publicly available, e.g., in public databases such as GenBank; journal articles; patents and published patent applications; and the like. For example, the amino acid sequences of human TPA are found under GenBank Accession Nos. P0070, NP__127509, and NP-000921; the amino acid sequence of a human Factor VIIa is found under GenBank Accession No. KFHU7; the amino acid sequence of a human Factor IX is found under GenBank Accession Nos. P00740 and NP__000124; the amino acid sequence of a human Factor VIII is found under GenBank Accession Nos. AAH64380, AAH22513, and P00451.

In one aspect, the parent polypeptide is ACTIVASE® alteplase and the protease-resistant, polypeptide variant is a protease-resistant variant of TNKase™ tenecteplase.

Colony Stimulating Factors

In some embodiments, a hyperglycosylated or protease-resistant, hyperglycosylated polypeptide variant comprises a colony stimulating factor polypeptide amino acid sequence, and further comprises at least one non-native glycosylation site compared to a parent colony stimulating factor polypeptide; and comprises at least one mutated protease cleavage site in place of a native protease cleavage site found in the parent polypeptide. Suitable colony stimulating factor polypeptides include, but are not limited to, granulocyte colony stimulating factor (G-CSF), such as NEUPOGEN® filgrastim and NEULASTA™ pegfilgrastim, granulocyte-monocyte colony stimulating factor (GM-CSF), such as LEUKINE® sargramostim, macrophage colony stimulating factor, megakaryocyte colony stimulating factor; IL-3; stem cell factor (SCF); and the like.

The amino acid sequences of various blood factors are publicly available, e.g., in public databases such as GenBank; journal articles; patents and published patent applications; and the like. For example, amino acid sequences of IL-3 are disclosed in U.S. Pat. Nos. 4,877,729 and 4,959,455, and International Patent Publication No. WO 88/00598; amino acid sequences of human G-CSF are disclosed in U.S. Pat. No. 4,810,643; WO 91/02754 and WO 92/04455 disclose the amino acid sequence of fusion proteins comprising IL-3; WO 95/21197, WO 95/21254, and U.S. Pat. No. 6,730,303 disclose fusion proteins capable of broad multi-functional hematopoietic properties; amino acid sequences of human G-CSF are found under GenBank Accession Nos. NP__757374, P010219, FQHUGL, and NP__000750; amino acid sequences of human GM-CSF are found under GenBank Accession Nos. NP_000749 and P04141; amino acid sequences of IL-3 are found under GenBank Accession Nos. AAH66272, AAH66273, and AAH66276; etc.

Growth Hormones

In some embodiments, a hyperglycosylated or protease-resistant, hyperglycosylated polypeptide variant comprises a growth hormone polypeptide amino acid sequence, and further comprises at least one non-native glycosylation site compared to a parent growth hormone polypeptide; and comprises at least one mutated protease cleavage site in place of a native protease cleavage site found in the parent polypeptide. Suitable growth hormone polypeptides include, but are not limited to, somatotropin; a human growth hormone; any of the growth hormone variants disclosed in U.S. Pat. Nos. 6,143,523, 6,136,563, 6,022,711, and 5,688,666; fusion proteins comprising a growth hormone, e.g., as disclosed in U.S. Pat. No. 5,889,144; growth hormone fragments that retain growth hormone activity; a growth hormone receptor polypeptide agonist as disclosed in U.S. Pat. No. 6,387,879; and the like. Growth hormones include alternative forms of known growth hormones, e.g., alternative forms of human growth hormone (hGH), including naturally-occurring derivatives, variants and metabolic products, degradation products primarily of biosynthetic hGH and engineered variants of hGH produced by recombinant methods (see, e.g., U.S. Pat. No. 6,348,444).

Growth Factors

In some embodiments, a hyperglycosylated or protease-resistant, hyperglycosylated polypeptide variant comprises a growth factor amino acid sequence comprising at least one non-native glycosylation site compared to a parent growth hormone polypeptide; and comprises at least one mutated protease cleavage site in place of a native protease cleavage site found in the parent polypeptide. Suitable growth factor polypeptides include, but are not limited to, keratinocyte growth factor; an acidic fibroblast growth factor, a stem cell factor, a basic fibroblast growth factor, a hepatocyte growth factor, an insulin-like growth factor, etc.; active fragments of a growth factor; fusion proteins comprising a growth factor; and the like. The amino acid sequences of various growth factors are publicly available, e.g., in public databases such as GenBank; journal articles; patents and published patent applications; and the like. For example, amino acid sequences of bFGF are found under GenBank Accession Nos. AAB20640, AAA57275, A43498, and AAB20639; amino acid sequences of aFGF are found under GenBank Accession Nos. AAB29059, CAA46661, and 1605206A; amino acid sequences of stem cell factor are found under GenBank Accession Nos. AAH69733, AAH69783, and AAH69797; amino acid sequences of keratinocyte growth factor are found under GenBank Accession Nos. O35565, AAL05875, and P21781; amino acid sequences of hepatocye growth factor are found under GenBank Accession Nos. AAA64239, AAB20169, and CAA40802.

Soluble Receptors

In some embodiments, a hyperglycosylated or protease-resistant, hyperglycosylated polypeptide variant comprises a soluble receptor polypeptide amino acid sequence, and further comprises at least one non-native glycosylation site compared to a parent soluble receptor polypeptide; and comprises at least one mutated protease cleavage site in place of a native protease cleavage site found in the parent polypeptide. Suitable soluble receptor polypeptides include, but are not limited to, a TNF-α-binding soluble receptor; a soluble VEGF receptor; a soluble interleukin receptor; a soluble IL-1 receptor; a soluble type II IL-1 receptor; a soluble γ/δ T cell receptor; ligand-binding fragments of a soluble receptor; and the like. Suitable soluble receptors bind a ligand that, under normal physiological conditions, binds to and activates the corresponding membrane-bound or cell surface receptor. Thus, a suitable soluble receptor is one that functions as a receptor antagonist, by binding the ligand that would ordinarily bind the receptor in its native (e.g., membrane-bound) form.

The amino acid sequences of various soluble receptors are publicly available, e.g., in public databases such as GenBank; journal articles; patents and published patent applications; and the like. For example, amino acid sequences of soluble VEGF receptors are found under GenBank Accession Nos. AAC50060 and NP_002010; soluble VEGF receptors are described in U.S. Pat. Nos. 6,383,486, 6,375,929, and 6,100,071; soluble IL-4 receptors are described in U.S. Pat. No. 5,5102,905; soluble IL-1 receptors are described in U.S. Patent Publication No. 20040023869; etc.

Chemokines

In some embodiments, a hyperglycosylated or protease-resistant, hyperglycosylated polypeptide variant comprises a chemokine polypeptide amino acid sequence, and further comprises at least one non-native glycosylation site compared to a parent chemokine polypeptide; and further comprises at least one mutated protease cleavage site in place of a native protease cleavage site found in the parent polypeptide. Suitable chemokine polypeptides include, but are not limited to, IP-10; Mig; Groα/IL-8, RANTES; MIP-1α; MIP-1; MCP-1; PF-4; and the like; as well as fusion proteins comprising a chemokine. The amino acid sequences of various chemokines are publicly available, e.g., in public databases such as GenBank; journal articles; patents and published patent applications; and the like. For example, amino acid sequences of IP-10 are disclosed in U.S. Pat. Nos. 6,491,906, 5,935,567, 6,153,600, 5,728,377, and 5,1024,292; amino acid sequences of Mig are disclosed in U.S. Pat. No. 6,491,906, and Farber (11023) Biochemical and Biophysical Research Communications 192(1):223-230; amino acid sequences of RANTES are disclosed in U.S. Pat. Nos. 6,709,649, 6,168,784, and 5,965,697; etc.

Angiogenic Agents

In some embodiments, a hyperglycosylated or protease-resistant, hyperglycosylated polypeptide variant comprises an angiogenic polypeptide amino acid sequence, and further comprises at least one non-native glycosylation site compared to a parent angiogenic polypeptide; and comprises at least one mutated protease cleavage site in place of a native protease cleavage site found in the parent polypeptide. Suitable angiogenic polypeptides include, but are not limited to, VEGF polypeptides, including $VEGF_{121}$, $VEGF_{165}$, VEGF-C, VEGF-2, etc.; transforming growth factor-beta; basic fibroblast growth factor; glioma-derived growth factor; angiogenin; angiogenin-2; and the like. The amino acid sequences of various angiogenic agents are publicly available, e.g., in public databases such as GenBank; journal articles; patents and published patent applications; and the like. For example, amino acid sequences of VEGF polypeptides are disclosed in U.S. Pat. Nos. 5,194,596, 5,332,671, 5,240,848, 6,475,796, 6,485,942, and 6,057,428; amino acid sequences of VEGF-2 polypeptides are disclosed in U.S. Pat. Nos. 5,726,152 and 6,608,182; amino acid sequences of glioma-derived growth factors having angiogenic activity are disclosed in U.S. Pat. Nos. 5,338,840 and 5,532,343; amino acid sequences of angiogenin are found under GenBank Accession Nos. AAA72611, AAA51678, AAA02369, AAL67710, AAL67711, AAL67712, AAL67713, and AAL67714; etc.

Neuroactive Peptides

In some embodiments, a hyperglycosylated or protease-resistant, hyperglycosylated polypeptide variant comprises a neuroactive polypeptide amino acid sequence, and further comprises at least one non-native glycosylation site compared to a parent neuroactive polypeptide; and comprises at least one mutated protease cleavage site in place of a native protease cleavage site found in the parent polypeptide. Suitable neuroactive polypeptides include, but are not limited to, nerve growth factor, bradykinin, cholecystokinin, gastin, secretin, oxytocin, gonadotropin-releasing hormone, beta-endorphin, enkephalin, substance P, somatostatin, prolactin, galanin, growth hormone-releasing hormone, bombesin, dynorphin, neurotensin, motilin, thyrotropin, neuropeptide Y, luteinizing hormone, calcitonin, insulin, glucagons, vasopressin, angiotensin II, thyrotropin-releasing hormone, vasoactive intestinal peptide, a sleep peptide, etc.

Additional Proteins

In its broadest sense, the compositions and methods of the invention contemplate the use of any hyperglycosylated or protease-resistant, hyperglycosylated polypeptide variant that comprises an amino acid sequence derived from a parent polypeptide of pharmacologic interest; and that further comprises at least one non-native glycosylation site compared to the parent polypeptide; and that further comprises at least one mutated protease cleavage site in place of a native protease cleavage site found in the parent polypeptide. Other proteins of pharmacologic interest include, but are not limited to, a thrombolytic agent, an atrial natriuretic peptide, bone morphogenic protein, thrombopoietin, glial fibrillary acidic protein, follicle stimulating hormone, a human alpha-1 antitrypsin, a leukemia inhibitory factor, a transforming growth factor, an insulin-like growth factor, a luteinizing hormone, a macrophage activating factor, tumor necrosis factor, a neutrophil chemotactic factor, a nerve growth factor a tissue inhibitor of metalloproteinases; a vasoactive intestinal peptide, angiotropin, fibrin; hirudin; a leukemia inhibitory factor; and the like. The amino acid sequences of various therapeutic proteins are publicly available, e.g., in public databases such as GenBank; journal articles; patents and published patent applications; and the like. For example, amino acid sequences of tissue plasminogen activator are found under GenBank Accession Nos. P00750, AAA01895, AAA01378, AAB06956, and CAA00642.

In some embodiments, a hyperglycosylated or protease-resistant, hyperglycosylated polypeptide variant comprises a relaxin amino acid sequence, and further comprises at least one non-native glycosylation site compared to a parent relaxin polypeptide; and further comprises at least one mutated protease cleavage site in place of a native protease cleavage site found in the parent polypeptide. The relaxin polypeptide can be a naturally-occurring relaxin or a synthetic relaxin. Naturally occurring biologically active relaxin may be derived from human, murine (i.e., rat or mouse), porcine, or other mammalian sources. The term "relaxin" encompasses human H1 preprorelaxin, prorelaxin, and relaxin; H2 preprorelaxin, prorelaxin, and relaxin; recombinant human relaxin (rhRLX); and H3 preprorelaxin, prorelaxin, and relaxin. H3 relaxin has been described in the art. See, e.g., Sudo et al. (2003) *J Biol. Chem.* 7; 278(10):7855-62. The amino acid sequences of human relaxin are described in the art. For example, human relaxin amino acid sequences are found under the following GenBank Accession Nos.: Q3WXF3, human H3 prorelaxin; P04808, human H1 prorelaxin; NP_604390 and NP_005050, human H2 prorelaxin; AAH05956, human relaxin 1 preproprotein; NP_008842, human H1 preprorelaxin; etc. The relaxin polypeptide can be a relaxin polypeptide comprising A and B chains having N- and/or C-terminal truncations. For example, in H2 relaxin, the A chain can be varied from A(1-24) to A(10-24) and B chain from B(⁻1-33) to B(10-22); and in H1 relaxin, the A chain can be varied from A(1-24) to A(10-24) and B chain from B(1-32) to B(10-22). Also suitable for modification is a relaxin analog having an amino acid sequence which differs from a wild-type (e.g., naturally-occurring) sequence, including, but not limited to, relaxin analogs disclosed in U.S. Pat. No. 5,811,395, and U.S. Pat. No. 6,200,953. Other suitable relaxins and relaxin formulations are found in U.S. Pat. No. 5,945,402. Other possible relaxin polypeptides include relaxin having a replacement of one or more of the natural amino-acids in the B and/or A chains with a different amino acid (including the D-form of a natural amino-acid), including, but not limited to, replacement of the Met moiety at B24 with norleucine (Nle), valine (Val), alanine (Ala), glycine (Gly), serine (Ser), or homoserine (HomoSer). Other possible relaxin polypeptides include relaxin having an amino acid substitutions at the B/C and C/A junctions of prorelaxin, which modifications facilitate cleavage of the C chain from prorelaxin; and variant relaxin comprising a non-naturally occurring C peptide, e.g., as described in U.S. Pat. No. 5,759,807.

Protease-resistant or Protease-resistant, Hyperglycosylated Polypeptide Variants of Parent Cytokine Polypeptides In some embodiments, a hyperglycosylated or protease-resistant, hyperglycosylated polypeptide variant is a variant of a parent protein therapeutic, and the parent protein therapeutic is a cytokine. In some embodiments, a hyperglycosylated or protease-resistant, hyperglycosylated polypeptide variant comprises one or more of the amino acid replacements, compared to an unmodified parent cytokine, as set forth in an amino acid sequence as depicted in any one of SEQ ID NOs:2-181 (IFN-α2b variants), 233-289 (IFN-β variants), 290-311 (IFN-γ variants), 362-400 (GM-CSF variants), 631-662 (G-CSF variants), 850-895 (hGH variants), 940-977 (EPO variants), 978-988 (IFN-α variants), and 989-1302 (IFN-β variants); and further comprises an amino acid sequence that differs from the amino acid sequence of the parent polypeptide to the extent that the variant comprises one or more glycosylation sites not found in the parent polypeptide. Exemplary amino acid replacements that generate hyperglycosylation are depicted in FIGS. 23-30. In some embodiments, a hyperglycosylated or protease-resistant, hyperglycosylated polypeptide variant is a structural homolog of a protein comprising an amino acid sequence as set forth in any one of SEQ ID NOs:2-181 (IFN-α2b variants), 233-289 (IFN-β variants), 290-311 (IFN-γ variants), 362-400 (GM-CSF variants), 631-662 (G-CSF variants), 850-895 (hGH variants), 940-977 (EPO variants), 978-988 (IFN-α variants), and 989-1302 (IFN-β variants); and further comprises an amino acid sequence that differs from the amino acid sequence of the parent polypeptide to the extent that the variant comprises one or more glycosylation sites not found in the parent polypeptide.

In some embodiments, a hyperglycosylated or protease-resistant, hyperglycosylated polypeptide variant comprises one or more of the amino acid replacements, compared to an unmodified parent cytokine, as set forth in an amino acid sequence as set forth in any one of SEQ ID NOs:87, 89, 90, 93, 96, 101, 103, 107, 124, 979, 980, 983, 984, 986, and 987;

and further comprises an amino acid sequence that differs from the amino acid sequence of the parent polypeptide to the extent that the variant comprises one or more glycosylation sites not found in the parent polypeptide.

In some embodiments, a hyperglycosylated or protease-resistant, hyperglycosylated polypeptide variant is a cytokine modified on the basis of 3-dimensional structural homology with any one of SEQ ID NOs:87, 89, 90, 93, 96, 101, 103, 107, 124, 979, 980, 983, 984, 986, and 987; where the variant further comprises an amino acid sequence that differs from the amino acid sequence of the parent polypeptide to the extent that the variant comprises one or more glycosylation sites not found in the parent polypeptide.

In some embodiments, the hyperglycosylated or protease-resistant, hyperglycosylated cytokine variant is selected from protease-resistant or protease-resistant, hyperglycosylated variants of: interleukin-10 (IL-10), interferon beta (IFNβ), interferon alpha-2a (IFN-α2a), interferon alpha-2b (IFN-α2b), interferon gamma (IFN-γ), granulocyte colony stimulating factor (G-CSF), leukemia inhibitory factor (LIF), human growth hormone (hGH), ciliary neurotrophic factor (CNTF), leptin, oncostatin M, interleukin-6 (IL-6), interleukin-12 (IL-12), erythropoietin (EPO), granulocyte-macrophage colony stimulating factor (GM-CSF), interleukin-2 (IL-2), interleukin-3 (IL-3), interleukin-4 (IL-4), interleukin-5 (IL-5), interleukin-13 (IL-13), Flt3 ligand and stem cell factor (SCF). In particular embodiments, the hyperglycosylated or protease-resistant, hyperglycosylated cytokine variant is selected from protease-resistant or protease-resistant, hyperglycosylated variants of IFNβ, IFN-α2α, IFN-α2b, IFN-γ, G-CSF, hGH, EPO, and GM-CSF. In particular embodiments, the known protease-resistant cytokine variant is an interferon.

The hyperglycosylated or protease-resistant, hyperglycosylated cytokine variant of a parent cytokine exhibits increased resistance to proteolysis compared to the unmodified (parent) cytokine. In some embodiments, the hyperglycosylated or protease-resistant, hyperglycosylated cytokine variant is an interferon variant. In some embodiments, the hyperglycosylated or protease-resistant, hyperglycosylated cytokine variant is an IFN-α2a variant. In some embodiments, the hyperglycosylated or protease-resistant, hyperglycosylated cytokine variant is an IFN-α2b variant. In some embodiments, the hyperglycosylated or protease-resistant, hyperglycosylated cytokine variant is an IFN-β variant. In some embodiments, the hyperglycosylated or protease-resistant, hyperglycosylated cytokine variant is an IFN-γ variant. In some embodiments, the hyperglycosylated or protease-resistant, hyperglycosylated cytokine variant is a variant of a consensus interferon comprising the amino acid sequence identified as SEQ ID NO:232, or as shown in FIG. 9, or as depicted in FIG. 24.

IFN-α Polypeptide Variants

In some embodiments, a hyperglycosylated or protease-resistant, hyperglycosylated polypeptide variant comprises one or more of the mutations shown in Table 1, below, where the amino acid numbering coincides with the amino acid numbering set forth in FIG. 1; and further comprises an amino acid sequence that differs from the amino acid sequence of the parent polypeptide to the extent that the variant comprises one or more glycosylation sites not found in the parent polypeptide.

TABLE 1

| IFN-α LEAD | SEQ ID N° | Mutation(s) |
|---|---|---|
| 1 | 983 | K121Q/P109A |
| 2 | 987 | E159H/Y89H |
| 3 | 124 | E159Q |
| 4 | 90 | E58H |
| 5 | 89 | E58Q |
| 6 | 979 | E41H/Y89H/N45D |
| 7 | 103 | L117I |
| 8 | 986 | R125H/M111V |
| 9 | 96 | E107H |
| 10 | 101 | E113H |
| 11 | 87 | E41Q |
| 12 | 107 | R125Q |
| 13 | 985 | L117V/A139G |
| 14 | 980 | E41Q/D94G |
| 15 | 93 | E78H |
| 16 | 984 | K133Q/K121Q/P109A/G102R |

In one aspect, the parent polypeptide is IFN-α2a or IFN-α2b and the hyperglycosylated or protease-resistant, hyperglycosylated polypeptide variant comprises one or more single amino acid replacements of the IFN-α2a amino acid sequence depicted in FIG. 1 or of the IFN-α2b amino acid sequence depicted in FIG. 2, corresponding to the replacement of: L by V at position 3; L by I at position 3; P by S at position 4; P by A at position 4; R by H at position 12; R by Q at position 12; R by H at position 13; R by Q at position 13; M by V at position 16; M by I at position 16; R by H at position 22; R by Q at position 22; R or K by H at position 23; R or K by Q at position 23; F by I at position 27; F by V at position 27; L by V at position 30; L by I at position 30; K by Q at position 31; K by T at position 31; R by H at position 33; R by Q at position 33; E by Q at position 41; E by H at position 41; K by Q at position 49; K by by T at position 49; E by Q at position 58; E by H at position 58; K by Q at position 70; K by T at position 70; E by Q at position 78; E by H at position 78; K by Q at position 83; K by T at position 83; Y by H at position 89; Y by I at position 89; E by Q at position 96; E by H at position 96; E by Q at position 107; E by H at position 107; P by S at position 109; P by A at position 109; L by V at position 110; L by I at position 110; M by V at position 111; M by I at position 111; E by Q at position 113; E by H at position 113; L by V at position 117; L by I at position 117; R by H at position 120; R by Q at position 120; K by Q at position 121; K by T at position 121; R by H at position 125; R by Q at position 125; L by V at position 128; L by I at position 128; K by Q at position 131; K by T at position 131; E by Q at position 132; E by H at position 132; K by Q at position 133; K by T at position 133; K by Q at position 138; K by T at position 138; Y by H at position 135; Y by I at position 135; P by S at position 137; P by A at position 137; M by V at position 148; M by I at position 148; R by H at position 149; R by Q at position 149; E by Q at position 159; E by H at position 159; L by V at position 161; L by I at position 161; R by H at position 162; R by Q at position 162; K by Q at position 164; K by T at position 164; E by Q at position 165; and E by H at position 165, wherein residue 1 corresponds to residue 1 of the mature IFN-α2a protein as depicted in FIG. 1 or wherein residue 1 corresponds to residue 1 of the mature IFN-α2b protein as depicted in FIG. 2; and further comprises an amino acid sequence that differs from the amino acid sequence of the parent polypeptide to the extent that the variant comprises one or more glycosylation sites not found in the parent polypeptide.

In another aspect, the parent polypeptide is IFN-α2a or IFN-α2b, and the hyperglycosylated or protease-resistant, hyperglycosylated polypeptide variant comprises one or more single amino acid replacements of the IFN-α2a amino acid sequence depicted in FIG. 1 or of the IFN-α2b amino acid sequence depicted in FIG. 2, corresponding to: F by V at position 27; R by H at position 33; E by Q at position 41; E by H at position 41; E by Q at position 58; E by H at position 58; E by Q at position 78; E by H at position 78; Y by H at position 89; E by Q at position 107; E by H at position 107; P by A at position 109: L by V at position 110; M by V at position 111; E by Q at position 113; E by H at position 113; L by V at position 117; L by I at position 117; K by Q at position 121; K by T at position 121; R by H at position 125; R by Q at position 125; K by Q at position 133; K by T at position 133; E by Q at position 159 and E by H at position 159, wherein residue 1 corresponds to residue 1 of the mature IFN-α2a protein as depicted in FIG. 1 or wherein residue 1 corresponds to residue 1 of the mature IFN-α2b protein as depicted in FIG. 2; and further comprises an amino acid sequence that differs from the amino acid sequence of the parent polypeptide to the extent that the variant comprises one or more glycosylation sites not found in the parent polypeptide.

In another aspect, the parent polypeptide is IFN-α2a or IFN-α2b, and the hyperglycosylated or protease-resistant, hyperglycosylated polypeptide variant comprises one or more sets of dual-amino acid replacements in the IFN-α2a amino acid sequence depicted in FIG. 1, or in the IFN-α2b amino acid sequence depicted in FIG. 2, corresponding to:

D by N at position 2 and P by S at position 4;
D by N at position 2 and P by T at position 4;
L by N at position 3 and Q by S at position 5;
L by N at position 3 and Q by T at position 5;
P by N at position 4 and T by S at position 6;
P by N at position 4 and T by T at position 6;
Q by N at position 5 and H by S at position 7;
Q by N at position 5 and H by T at position 7;
T by N at position 6 and S by S at position 8;
T by N at position 6 and S by T at position 8;
H by N at position 7 and L by S at position 9;
H by N at position 7 and L by T at position 9;
S by N at position 8 and G by S at position 10;
S by N at position 8 and G by T at position 10;
L by N at position 9 and S by S at position 11;
L by N at position 9 and S by T at position 11;
M by N at position 21 and K by S at position 23;
M by N at position 21 and K by T at position 23;
R by N at position 22 and I by S at position 24;
R by N at position 22 and I by T at position 24;
R or K by N at position 23 and S by S at position 25;
R or K by N at position 23 and S by T at position 25;
I by N at position 24 and L by S at position 26;
I by N at position 24 and L by T at position 26;
S by N at position 25 and F by S at position 27;
S by N at position 25 and F by T at position 27;
L by N at position 26 and S by S at position 28;
L by N at position 26 and S by T at position 28;
S by N at position 28 and L by S at position 30;
S by N at position 28 and L by T at position 30;
L by N at position 30 and D by S at position 32;
L by N at position 30 and D by T at position 32;
K by N at position 31 and R by S at position 33;
K by N at position 31 and R by T at position 33;
D by N at position 32 and H by S at position 34;
D by N at position 32 and H by T at position 34;
R by N at position 33 and D by S at position 35;
R by N at position 33 and D by T at position 35;
H by N at position 34 and F by S at position 36;
H by N at position 34 and F by T at position 36;
D by N at position 35 and G by S at position 37;
D by N at position 35 and G by T at position 37;
F by N at position 36 and F by S at position 38;
F by N at position 36 and F by T at position 38;
G by N at position 37 and P by S at position 39;
G by N at position 37 and P by T at position 39;
F by N at position 38 and Q by S at position 40;
F by N at position 38 and Q by T at position 40;
P by N at position 39 and E by S at position 41;
P by N at position 39 and E by T at position 41;
Q by N at position 40 and E by S at position 42;
Q by N at position 40 and E by T at position 42;
E by N at position 41 and F by S at position 43;
E by N at position 41 and F by T at position 43;
E by N at position 42 and G by S at position 44;
E by N at position 42 and G by T at position 44;
F by N at position 43 and N by S at position 45;
F by N at position 43 and N by T at position 45;
G by N at position 44 and Q by S at position 46;
G by N at position 44 and Q by T at position 46;
N by N at position 45 and F by S at position 47;
N by N at position 45 and F by T at position 47;
Q by N at position 46 and Q by S at position 48;
Q by N at position 46 and Q by T at position 48;
F by N at position 47 and K by S at position 49;
F by N at position 47 and K by T at position 49;
Q by N at position 48 and A by S at position 50;
Q by N at position 48 and A by T at position 50;
K by N at position 49 and E by S at position 51;
K by N at position 49 and E by T at position 51;
A by N at position 50 and T by S at position 52;
A by N at position 50 and T by T at position 52;
S by N at position 68 and K by S at position 70;
S by N at position 68 and K by T at position 70;
K by N at position 70 and S by S at position 72;
K by N at position 70 and S by T at position 72;
A by N at position 75 and D by S at position 77;
A by N at position 75 and D by T at position 77;
D by N at position 77 and T by S at position 79;
D by N at position 77 and T by T at position 79;
I by N at position 100 and G by S at position 102;
I by N at position 100 and G by T at position 102;
Q by N at position 101 and V by S at position 103;
Q by N at position 101 and V by T at position 103;
G by N at position 102 and G by S at position 104;
G by N at position 102 and G by T at position 104;
V by N at position 103 and V by S at position 105;
V by N at position 103 and V by T at position 105;
G by N at position 104 and T by S at position 106;
G by N at position 104 and T by T at position 106;
V by N at position 105 and E by S at position 107;
V by N at position 105 and E by T at position 107;
T by N at position 106 and T by S at position 108;
T by N at position 106 and T by T at position 108;
E by N at position 107 and P by S at position 109;
E by N at position 107 and P by T at position 109;
T by N at position 108 and I by S at position 110;
T by N at position 108 and I by T at position 110;
K by N at position 138 and S by S at position 136;
K by N at position 138 and S by T at position 136;
S by N at position 154 and N by S at position 156;
S by N at position 154 and N by T at position 156;
T by N at position 155 and L by S at position 157;
T by N at position 155 and L by T at position 157;
N by N at position 156 and Q by S at position 158;
N by N at position 156 and Q by T at position 158;
L by N at position 157 and E by S at position 159;

L by N at position 157 and E by T at position 159;
Q by N at position 158 and S by S at position 160;
Q by N at position 158 and S by T at position 160;
E by N at position 159 and L by S at position 161;
E by N at position 159 and L by T at position 161;
S by N at position 160 and R by S at position 162;
S by N at position 160 and R by T at position 162;
L by N at position 161 and S by S at position 163;
L by N at position 161 and S by T at position 163;
R by N at position 162 and K by S at position 164;
R by N at position 162 and K by T at position 164;
S by N at position 163 and E by S at position 165; and
S by N at position 163 and E by T at position 165, wherein residue 1 corresponds to residue 1 of the mature IFN-α2a depicted in FIG. 1, or IFN-α2b depicted in FIG. 2; and further comprises an amino acid sequence that differs from the amino acid sequence of the parent polypeptide to the extent that the variant comprises one or more glycosylation sites not found in the parent polypeptide.

In another aspect, the parent polypeptide is IFN-α2a or IFN-α2b, and the hyperglycosylated or protease-resistant, hyperglycosylated polypeptide variant comprises one or more sets of dual-amino acid replacements in the IFN-α2a amino acid sequence depicted in FIG. 1, or in the IFN-α2b amino acid sequence depicted in FIG. 2, corresponding to:
    Q by N at position 5 and H by S at position 7;
    P by N at position 39 and E by S at position 41;
    P by N at position 39 and E by T at position 41;
    Q by N at position 40 and E by S at position 42;
    Q by N at position 40 and E by T at position 42;
    E by N at position 41 and F by S at position 43;
    E by N at position 41 and F by T at position 43;
    F by N at position 43 and N by S at position 45;
    G by N at position 44 and Q by T at position 46;
    N by N at position 45 and F by S at position 47;
    N by N at position 45 and F by T at position 47;
    Q by N at position 46 and Q by S at position 48;
    F by N at position 47 and K by S at position 49;
    F by N at position 47 and K by T at position 49;
    I by N at position 100 and G by S at position 102;
    I by N at position 100 and G by T at position 102;
    V by N at position 105 and E by S at position 107;
    V by N at position 105 and E by T at position 107;
    T by N at position 106 and T by S at position 108;
    T by N at position 106 and T by T at position 108;
    E by N at position 107 and P by S at position 109;
    E by N at position 107 and P by T at position 109;
    L by N at position 157 and E by S at position 159;
    L by N at position 157 and E by T at position 159;
    E by N at position 159 and L by S at position 161; and
    E by N at position 159 and L by T at position 161, wherein residue 1 corresponds to residue 1 of the mature IFN-α2a depicted in FIG. 1, or IFN-α2b depicted in FIG. 2; and further comprises an amino acid sequence that differs from the amino acid sequence of the parent polypeptide to the extent that the variant comprises one or more glycosylation sites not found in the parent polypeptide.

In some embodiments, the hyperglycosylated or protease-resistant, hyperglycosylated cytokine variant is an IFN-α2b, IFN-α2a, or an IFN-2c variant comprising one or more single amino acid replacements corresponding to the replacement of: N by D at position 45; D by G at position 94; G by R at position 102; A by G at position 139; or any combination thereof, where the amino acid numbering is as set forth in FIG. 1.

In some embodiments, a hyperglycosylated or protease-resistant, hyperglycosylated cytokine variant is an IFN-α2b, IFN-α2a, or an IFN-2c variant comprising one or more single amino acid replacements in any of SEQ ID Nos. 1, 182, 185 or 232 (e.g., in any of the sequences set forth in FIGS. 2, 1, 11, and 9, respectively) corresponding to the replacement: L by V at position 3; L by I at position 3; P by S at position 4; P by S at position 4; P by A at position 4; R by H at position 12; R by Q at position 12; R by H at position 13; R by Q at position 13; M by V at position 16; M by I at position 16; R by H at position 22; R by Q at position 22; R or K by H at position 23; R or K by Q at position 23; F by I at position 27; F by V at position 27; L by V at position 30; L by I at position 30; K by Q at position 31; K by T at position 31; R by H at position 33; R by Q at position 33; E by Q at position 41; E by H at position 41; K by Q at position 49; K by T at position 49; E by Q at position 58; E by H at position 58; K by Q at position 70; K by T at position 70; E by Q at position 78; E by H at position 78; K by Q at position 83; K by T at position 83; Y by H at position 89; Y by I at position 89; E by Q at position 96; E by H at position 96; E by Q at position 107; E by H at position 107; P by S at position 109; P by A at position 109; L by V at position 110; L by I at position 110; M by V at position 111; M by I at position 111; E by Q at position 113; E by H at position 113; L by V at position 117; L by I at position 117; R by H at position 120; R by Q at position 120; K by Q at position 121; K by T at position 121; R by H at position 125; R by Q at position 125; L by V at position 128; L by I at position 128; K by Q at position 131; K by T at position 131; E by Q at position 132; E by H at position 132; K by Q at position 133; K by T at position 133; K by Q at position 138; K by T at position 138; Y by H at position 135; Y by I at position 135; P by S at position 137; P by A at position 137; M by V at position 148; M by I at position 148; R by H at position 149; R by Q at position 149; E by Q at position 159; E by H at position 159; L by V at position 161; L by I at position 161; R by H at position 162; R by Q at position 162; K by Q at position 164; K by T at position 164; E by Q at position 165; or E by H at position 165; or any combination thereof, wherein residue 1 corresponds to residue 1 of the mature IFN-α2b or IFN-α2a cytokine set forth in SEQ ID NOS:1 or 182 (or as set forth in FIGS. 2 and 1, respectively); and further comprising an amino acid sequence that differs from the amino acid sequence of the parent polypeptide to the extent that the variant comprises one or more glycosylation sites not found in the parent polypeptide.

In some embodiments, the hyperglycosylated or protease-resistant, hyperglycosylated cytokine variant is an IFN-α2b, IFN-α2a, or an IFN-2c variant comprising one or more single amino acid replacements in any of SEQ ID Nos. 1, 182, 185 or 232 (e.g., in any of the sequences set forth in FIGS. 2, 1, 11, and 9, respectively) corresponding to the replacement: L by V at position 3; L by I at position 3; P by S at position 4; P by A at position 4; R by H at position 12; R by Q at position 12; R by H at position 13; R by Q at position 13; M by V at position 16; M by I at position 16; R by H at position 22; R by Q at position 22; R or K by H at position 23; R or K by Q at position 23; F by I at position 27; F by V at position 27; L by V at position 30; L by I at position 30; K by Q at position 31; K by T at position 31; R by H at position 33; R by Q at position 33; E by Q at position 41; E by H at position 41; K by Q at position 49; K by T at position 49; E by Q at position 58; E by H at position 58; K by Q at position 70; K by T at position 70; E by Q at position 78; E by H at position 78; K by Q at position 83; K by T at position 83; Y by H at position 89; Y by I at position 89; E by Q at position 96; E by H at position 96; E by Q at position 107; E by H at position 107; P by S at position 109; P by A at position 109; L by V at position 110; L by I at position 110; M by V at position 111; M by I at position 111;

E by Q at position 113; E by H at position 113; L by V at position 117; L by I at position 117; R by H at position 120; R by Q at position 120; K by Q at position 121; K by T at position 121; R by H at position 125; R by Q at position 125; L by V at position 128; L by I at position 128; K by Q at position 131; K by T at position 131; E by Q at position 132; E by H at position 132; K by Q at position 133; K by T at position 133; K by Q at position 138; K by T at position 138; Y by H at position 135; Y by I at position 135; P by S at position 137; P by A at position 137; M by V at position 148; M by I at position 148; R by H at position 149; R by Q at position 149; E by Q at position 159; E by H at position 159; L by V at position 161; L by I at position 161; R by H at position 162; R by Q at position 162; K by Q at position 164; K by T at position 164; E by Q at position 165; E by H at position 165; N by D at position 45; D by G at position 94; G by R at position 102; or A by G at position 139; or any combination thereof, wherein residue 1 corresponds to residue 1 of the mature IFN-α2b or IFN-α2a cytokine set forth in SEQ ID No. 1 or 182; and further comprising an amino acid sequence that differs from the amino acid sequence of the parent polypeptide to the extent that the variant comprises one or more glycosylation sites not found in the parent polypeptide.

In some embodiments, any of the above-described protease-resistant or protease-resistant, hyperglycosylated IFN-α2a variants is an [D102N]IFN-α2a glycopeptide, where the [D102N]IFN-α2a glycopeptide is a variant of IFN-α2a having (a) an asparagine residue in place of the native aspartic acid residue at amino acid position 102 in the amino acid sequence of IFN-α2a corresponding to the native aspartic acid residue at amino acid position 99 depicted in FIG. 24 (where the amino acid position is as set forth in FIG. 24; and corresponds to D71 of the sequence set forth in FIG. 1); and (b) a carbohydrate moiety covalently attached to the R-group of said asparagine residue. In some embodiments, the IFN-α2a sequence has a lysine residue in place of the arginine residue at amino acid position 50 in the IFN-α2b sequence shown in FIG. 24 (corresponding to amino acid position 23 of the IFN-α2b sequence shown in FIG. 2).

In some embodiments, any of the above-described protease-resistant or protease-resistant, hyperglycosylated IFN-α2a variants is an [D102N, D108N]IFN-α2a glycopeptide, where the [D102N, D108N]IFN-α2a glycopeptide is a variant of IFN-α2a having (a) an asparagine residue in place of the native aspartic acid residue at each of amino acid positions 102 and 108 in the amino acid sequence of IFN-α2a corresponding to the native aspartic acid residue at amino acid positions 99 and 105 depicted in FIG. 24 (where the amino acid positions are as set forth in FIG. 24; and where D99 and D105 in FIG. 24 correspond to D71 and D77, respectively, in FIG. 1); and (b) a carbohydrate moiety covalently attached to the R-group of each of said asparagine residues. In some embodiments, the IFN-α2a sequence has a lysine residue in place of the arginine residue at amino acid position 50 in the IFN-α2b sequence shown in FIG. 24 (corresponding to Arg 23 in the IFN-α2b sequence shown in FIG. 2).

In some embodiments, any of the above-described protease-resistant or protease-resistant, hyperglycosylated IFN-α2b variants is an [D102N]IFN-α2b glycopeptide, where the [D102N]IFN-α2b glycopeptide is a variant of IFN-α2b having (a) an asparagine residue in place of the native aspartic acid residue at amino acid position 102 in the amino acid sequence of IFN-α2b corresponding to the native aspartic acid residue at amino acid position 99 depicted in FIG. 24 (where the amino acid position is as set forth in FIG. 24; and where D99 in FIG. 24 corresponds to D71 in FIGS. 1 and 2); and (b) a carbohydrate moiety covalently attached to the R-group of said asparagine residue.

In some embodiments, any of the above-described protease-resistant or protease-resistant, hyperglycosylated IFN-α2b variants is an [D102N, D108N]IFN-α2b glycopeptide, where the [D102N, D108N]IFN-α2b glycopeptide is a variant of IFN-α2b having (a) an asparagine residue in place of the native aspartic acid residue at each of amino acid positions 102 and 108 in the amino acid sequence of IFN-α2b corresponding to the native aspartic acid residues at amino acid positions 99 and 105 depicted in FIG. 24 (where the amino acid positions are as set forth in FIG. 24; and where D99 and D105 in FIG. 24 correspond to D71 and D77, respectively, in FIGS. 1 and 2); and (b) a carbohydrate moiety covalently attached to the R-group of each of said asparagine residues.

In another aspect, any of the aforementioned protease-resistant or protease-resistant, hyperglycosylated IFN-α2a or IFN-α2b polypeptide variants further comprises one or more pseudo-wild type mutations. In particular embodiments, any of the aforementioned protease-resistant or protease-resistant, hyperglycosylated IFN-α2a polypeptide variants further comprises one or more pseudo-wild type mutations at one or more of amino acid residues 9, 10, 17, 20, 24, 25, 35, 37, 41, 52, 54, 56, 57, 58, 60, 63, 64, 65, 76, 89, and 90 as depicted in FIG. 1, wherein the mutation(s) are one or more of an insertion, a deletion, and a replacement of the native amino acid residue. In other particular embodiments, any of the aforementioned protease-resistant or protease-resistant, hyperglycosylated IFN-α2b polypeptide variants further comprises one or more pseudo-wild type mutations at one or more of amino acid residues 9, 10, 17, 20, 24, 25, 35, 37, 41, 52, 54, 56, 57, 58, 60, 63, 64, 65, 76, 89, and 90 as depicted in FIG. 2, wherein the mutation(s) are one or more of an insertion, a deletion, and a replacement of the native amino acid residue.

Exemplary pseudo-wild type replacements are one or more mutations in the IFN-α2a amino acid sequence depicted in FIG. 1, or the IFN-α2b amino acid sequence depicted in FIG. 2, corresponding to: P by A at position 4; Q by A at position 5, T by A at position 6; L by A at position 9, LG by A at position 10; L by A at position 17, Q by A at position 20; I by A at position 24, S by A at position 25; D by A at position 35, G by A at position 37; G by A at position 39; E by A at position 41; E by A at position 42 E by A at position 51; T by A at position 52, P by A at position 54; V by A at position 55 L by A at position 56; H by A at position 57, E by A at position 58; I by A at position 60, I by A at position 63; F by A at position 64, N by A at position 65; W by A at position 76, D by A at position 77; E by A at position 78 L by A at position 81; Y by A at position 85 Y by A at position 89; Q by A at position 90 G by A at position 104; L by A at position 110 S by A at position 115 and E by A at position 146.

In another aspect, any of the aforementioned protease-resistant or protease-resistant, hyperglycosylated IFN-α2a or IFN-α2b polypeptide variants further comprises one or more pseudo-wild type mutations. In particular embodiments, any of the aforementioned protease-resistant IFN-α2a polypeptide variants further comprises one or more pseudo-wild type mutations at one or more of amino acid residues 4, 5, 6, 9, 10, 17, 20, 24, 25, 35, 37, 39, 41, 42, 51, 52, 54, 56, 57, 58, 60, 63, 64, 65, 76, 77, 78, 81, 85, 89, 90, 104, 110, 115 and 146 as depicted in FIG. 1, wherein the mutation(s) are one or more of an insertion, a deletion, and a replacement of the native amino acid residue. In other particular embodiments, any of the aforementioned protease-resistant or protease-resistant, hyperglycosylated IFN-α2b polypeptide variants further comprises one or more pseudo-wild type mutations at one or more of amino acid residues 4, 5, 6, 9, 10, 17, 20, 24, 25, 35, 37, 39, 41, 42, 51, 52, 54, 56, 57, 58, 60, 63, 64, 65, 76, 77, 78, 81, 85, 89, 90, 104, 110, 115 and 146 as depicted in FIG. 2, wherein the mutation(s) are one or more of an insertion, a deletion, and a replacement of the native amino acid residue.

Exemplary pseudo-wild type replacements are one or more mutations in the IFN-α2a amino acid sequence depicted in FIG. 1, or the IFN-α2b amino acid sequence depicted in FIG. 2, corresponding to: P by A at position 4; Q by A at position 5; T by A at position 6; L by A at position 9; LG by A at position 10; L by A at position 17; Q by A at position 20; I by A at position 24; S by A at position 25; D by A at position 35; G by A at position 37; G by A at position 39; E by A at position 41; E by A at position 42; E by A at position 51; T by A at position 52; P by A at position 54; V by A at position 55; L by A at position 56; H by A at position 57; E by A at position 58; I by A at position 60; I by A at position 63; F by A at position 64; N by A at position 65; W by A at position 76; D by A at position 77; E by A at position 78; L by A at position 81; Y by A at position 85; Y by A at position 89, Q by A at position 90; G by A at position 104; L by A at position 110; S by A at position 115 and E by A at position 146.

In some embodiments, the hyperglycosylated or protease-resistant, hyperglycosylated polypeptide variant is a variant of a parent cytokine that exhibits anti-viral activity. In some embodiments, the hyperglycosylated or protease-resistant, hyperglycosylated anti-viral cytokine (e.g., a protease-resistant or protease-resistant, hyperglycosylated variant of IFN-α2a polypeptide, an IFN-α2b polypeptide, an IFN-γ polypeptide) exhibits at least about 10%, at least about 20%, at least about 30%, at least about 40%, at least about 50%, at least about 60%, at least about 70%, at least about 80%, at least about 90%, or up to about 100% retention of the antiviral activity when compared to the corresponding unmodified (parent) cytokine (e.g., when compared to the parent IFN-α2a polypeptide, an IFN-α2b polypeptide, or IFN-γ polypeptide).

Antiviral activity is readily detected using any known assay. For example, the antiviral activity of an IFN-α2a polypeptide is tested in vitro in the following manner. An interferon-sensitive HeLa cell line (e.g., ATCC accession no. CCL-2) is contacted in vitro with an IFN-α2a polypeptide; subsequently, the cells are contacted with encephalomyocarditis virus (EMCV). Antiviral activity is detected by assessing cytopathic effect (CPE); or by measuring the amount of EMCV mRNA in extracts of infected cells using reverse transcription-polymerase chain reaction (RT-PCR).

The assay can be quantitative. For example, in some embodiments, the antiviral activity is assessed by reverse transcription quantitative polymerase chain reaction (RT-qPCR). For example, confluent cells (e.g., ATCC accession no. CCL-2) are plated at a density of $2\times10^4$ cells/well in a suitable culture medium (e.g., DMEM 5% SVF medium). Cells are then incubated with IFN-α2b at a concentration of 500 U/ml for 24 hours at 37° C. After the 24-hour incubation with IFN-α2b, the cells are challenged with EMCV (MOI=100). After incubation with virus for 16 hours, or when virus-induce CPE is near maximum in control cells not treated with IFN-α2b, the number of EMCV particles in each well is determined by RT-PCR quantification of EMCV mRNA in cell lysates. RNA is purified from the cell lysates. See, e.g., U.S. Patent Publication No. 2004/0132977.

In some embodiments, the hyperglycosylated or protease-resistant, hyperglycosylated polypeptide variant is effective in reducing viral load in an individual. Viral load can be measured by measuring the titer or level of virus in serum. These methods include, but are not limited to, a quantitative polymerase chain reaction (PCR) and a branched DNA (bDNA) test. Quantitative assays for measuring the viral load (titer) of HCV RNA have been developed. Many such assays are available commercially, including a quantitative reverse transcription PCR (RT-PCR) (Amplicor HCV Monitor™, Roche Molecular Systems, New Jersey); and a branched DNA (deoxyribonucleic acid) signal amplification assay (Quantiplex™ HCV RNA Assay (bDNA), Chiron Corp., Emeryville, Calif.). See, e.g., Gretch et al. (11025) *Ann. Intern. Med.* 123:321-329. Also of interest is a nucleic acid test (NAT), developed by Gen-Probe Inc. (San Diego) and Chiron Corporation, and sold by Chiron Corporation under the trade name Procleix®, which NAT simultaneously tests for the presence of HIV-1 and HCV. See, e.g., Vargo et al. (2002) *Transfusion* 42:876-885.

In some embodiments, the hyperglycosylated or protease-resistant, hyperglycosylated anti-viral cytokine variant (e.g., a protease-resistant variant of IFN-α2a polypeptide, an IFN-α2b polypeptide, an IFN-γ polypeptide) exhibits retention of anti-proliferative activity compared to the unmodified (parent) cytokine protein therapeutic.

Anti-proliferative activity can be measured using any known method. For example, anti-proliferative activity is assessed by measuring cell proliferation in the presence of the protease-resistant anti-viral cytokine variant, where cell proliferation is measured using any convenient assay. Cell proliferation is measured using assays based on $^3$H-thymidine incorporation; incorporation of the thymidine analog BrdU; cleavage of a tetrazolium salt; DNA-dye complex formation; and the like. One non-limiting example of a suitable assay for cell proliferation is The CellTiter 96® AQueous Non-Radioactive Cell Proliferation Assay (Promega). The CellTiter 96® Aqueous assay is a colorimetric method for determining the number of viable cells in proliferation or chemosensitivity assays. The CellTiter 96® AQueous Assay is composed of solutions of a tetrazolium compound (3-(4,5-dimethylthiazol-2-yl)-5-(3-carboxymethoxyphenyl)-2-(4-sulfophenyl)-2H-tetrazolium, inner salt; MTS) and an electron coupling reagent (phenazine methosulfate; PMS). MTS is bioreduced by cells into a formazan product that is soluble in tissue culture medium. The absorbance of the formazan at 490 nm can be measured directly from 96 well assay plates without additional processing. The conversion of MTS into aqueous, soluble formazan is accomplished by dehydrogenase enzymes found in metabolically active cells. The quantity of formazan product as measured by the amount of 490 nm absorbance is directly proportional to the number of living cells in culture.

In some embodiments, the hyperglycosylated or protease-resistant, hyperglycosylated anti-viral cytokine variant (e.g., a hyperglycosylated, protease-resistant variant of IFN-α2a polypeptide, an IFN-α2b polypeptide, an IFN-γ polypeptide) binds to an interferon receptor, but exhibits decreased antiviral activity compared to the unmodified (parent) cytokine protein therapeutic, or exhibits decreased anti-proliferative activity, compared to the parent cytokine protein therapeutic.

In some embodiments, the hyperglycosylated or protease-resistant, hyperglycosylated anti-viral cytokine variant (e.g., a protease-resistant variant of IFN-α2a polypeptide, an IFN-α2b polypeptide, an IFN-γ polypeptide) comprises two or more mutations, e.g., the protease-resistant anti-viral cytokine variant comprises two, three, four, five, six, seven, eight, nine, or ten single amino acid changes compared to the corresponding parent cytokine. In some embodiments, the hyperglycosylated or protease-resistant, hyperglycosylated anti-viral cytokine variant is a variant of an IFN-α2a polypeptide. In other embodiments, the hyperglycosylated or protease-resistant, hyperglycosylated anti-viral cytokine variant is a variant of an IFN-α2a polypeptide. In other embodiments, the hyperglycosylated or protease-resistant, hyperglycosylated anti-viral cytokine variant is a variant of an IFN-γ polypeptide.

In some embodiments, the hyperglycosylated or protease-resistant, hyperglycosylated polypeptide cytokine variant comprises an amino acid sequence as set forth in any one of SEQ ID NOs:2-181, where the arginine at position 23 is replaced with a lysine; and further comprises an amino acid sequence that differs from the amino acid sequence of the parent polypeptide to the extent that the variant comprises one or more glycosylation sites not found in the parent polypeptide. In other embodiments, the hyperglycosylated or protease-resistant, hyperglycosylated polypeptide cytokine variant exhibits greater resistance to proteolysis compared to the unmodified (parent) cytokine, and the protease-resistant or protease-resistant, hyperglycosylated polypeptide cytokine variant comprises one or more amino acid replacements at one or more positions on the cytokine, corresponding to a structurally-related modified amino acid position within the 3-D structure of a IFN-α2a polypeptide, a IFN-α2b polypeptide, a IFN-α2c polypeptide, or a consensus IFN-α as depicted in FIG. 9. In some embodiments, resistance to proteolysis is measured by contacting the polypeptide variant in vitro, as described above. In other embodiments, resistance to proteolysis is measured by contacting the polypeptide variant in vitro or in vivo with blood (e.g., human blood). In other embodiments, resistance to proteolysis is measured by contacting the polypeptide variant in vitro with serum (e.g., human serum), as described above.

In some embodiments, any of the above-described protease-resistant or protease-resistant, hyperglycosylated polypeptide IFN-α2b variants has increased stability compared to the unmodified (parent) cytokine, where the stability is assessed by measuring residual biological activity to either inhibit viral replication or to inhibit cell proliferation in appropriate cells, after incubation with either a mixture of proteases, individual proteases, blood lysate, or serum, as described above.

In some embodiments, any of the above-described protease-resistant or protease-resistant, hyperglycosylated polypeptide IFN-α2b variants has increased biological activity compared to the unmodified (parent) cytokine, where the activity is assessed by the capacity to either inhibit viral replication in appropriate cells, or to inhibit cell proliferation in appropriate cells, after incubation with either a mixture of proteases, individual proteases, blood lysate, or serum, as described above.

In some embodiments, any of the above-described protease-resistant or protease-resistant, hyperglycosylated polypeptide IFN-α2a variants has increased stability compared to the unmodified (parent) cytokine, where the stability is assessed by measuring residual biological activity to either inhibit viral replication or to inhibit cell proliferation in appropriate cells, after incubation with either a mixture of proteases, individual proteases, blood lysate, or serum, as described above.

In some embodiments, any of the above-described protease-resistant or protease-resistant, hyperglycosylated polypeptide IFN-α2a variants has increased biological activity compared to the unmodified (parent) cytokine, where the activity is assessed by the capacity to either inhibit viral replication in appropriate cells, or to inhibit cell proliferation in appropriate cells, after incubation with either a mixture of proteases, individual proteases, blood lysate, or serum, as described above.

In some embodiments, any of the above-described protease-resistant or protease-resistant, hyperglycosylated polypeptide IFN-α2c variants has increased stability compared to the unmodified (parent) cytokine, where the stability is assessed by measuring residual biological activity after incubation with either a mixture of proteases, individual proteases, blood lysate, or serum, as described above.

In some embodiments, any of the above-described protease-resistant or protease-resistant, hyperglycosylated polypeptide IFN-α2c variants has increased biological activity compared to the unmodified (parent) cytokine, after incubation with either a mixture of proteases, individual proteases, blood lysate, or serum, as described above.

3-D Structural Homologs

In some embodiments, a hyperglycosylated, protease-resistant polypeptide variant is a modified cytokine. In some embodiments, a hyperglycosylated, protease-resistant cytokine variant is a modified interferon. In some embodiments, any of the above-described hyperglycosylated, protease-resistant cytokine variants that is a structural homolog of IFN-α2b comprises one or more amino acid replacements at positions corresponding to the 3—dimensional-structurally-similar modified positions within the 3-D structure of the modified IFN-α2b, IFN-α2a, IFN-α2c, or a consensus IFN-α as depicted in FIG. 9. In some embodiments, the structural homolog has increased resistance to proteolysis compared to its unmodified (parent) cytokine counterpart, where the resistance to proteolysis is measured by mixture with a protease in vitro, incubation with blood or incubation with serum, as described above.

In some embodiments, the hyperglycosylated, protease-resistant cytokine variant is a structural homolog of an IFN-α cytokine. In some embodiments, the hyperglycosylated, protease-resistant IFN-α variant is a structural homolog of IFN-α2b. In some of these embodiments, the IFN-α cytokine is selected from variants of IFN-α2a, IFN-α2c, IFN-α, IFN-ad, IFN-α5, IFN-α6, IFN-α4, IFN-α4b, IFN-αI, IFN-αJ, IFN-αH, IFN-αF, IFN-α8, and a consensus IFN-α. Thus, in some embodiments, the known hyperglycosylated, protease-resistant IFN-α variant comprises one or more amino acid replacements at one or more target positions in the amino acid sequence of IFN-α2a, IFN-α2c, IFN-α, IFN-ad, IFN-α5, IFN-α6, IFN-α4, IFN-α4b, IFN-αI, IFN-αJ, IFN-αH, IFN-αF, IFN-α8, or a consensus IFN-α, corresponding to a structurally-related modified amino acid position within the 3-dimensional structure of the IFN-α2b modified proteins described above. The replacements lead to greater resistance to proteases, as assessed by incubation with a protease or a with a blood lysate or by incubation with serum, compared to the unmodified (parent) IFN-α, e.g., compared to a parent IFN-α2a, or IFN-α2b polypeptide.

In some embodiments, the hyperglycosylated, protease-resistant IFN-α variant is a modified IFN-α2a cytokine, comprising one or more amino acid replacements at one or more target positions in the amino acid sequence set forth in FIG. 1 (or SEQ ID NO:182) corresponding to a structurally-related modified amino acid position within the 3-dimensional structure of an above-described IFN-α2b variant, where the replacement(s) lead to greater resistance to proteases, as assessed by incubation with a protease or with a blood lysate or by incubation with serum (as described above), compared to the unmodified IFN-α2a.

In some embodiments, the hyperglycosylated, protease-resistant IFN-α2a variant comprises one or more single amino acid replacements at one or more target positions in SEQ ID NO: 182 (or the amino acid sequence set forth in FIG. 1), corresponding to any of amino acid positions: 41, 58, 78, 107, 117, 125, 133 and 159; and further comprises an amino acid sequence that differs from the amino acid sequence of the parent polypeptide to the extent that the variant comprises one or more glycosylation sites not found in the parent polypeptide.

In other embodiments, the hyperglycosylated, protease-resistant IFN-α variant is a modified IFN-αc cytokine, comprising one or more amino acid replacements at one or more target positions in SEQ ID NO:183 (as set forth in FIG. 10) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α. In some of these embodiments, the modified IFN-α is selected from among proteins comprising one or more single amino acid replacements at one or more target positions in SEQ ID NO: 183 (as set forth in FIG. 10), corresponding to any of amino acid positions: 41, 59, 79, 108, 118, 126, 138 and 160; where the variant further comprises an amino acid sequence that differs from the amino acid sequence of the parent polypeptide to the extent that the variant comprises one or more glycosylation sites not found in the parent polypeptide.

In other embodiments, the hyperglycosylated, protease-resistant IFN-α variant is a modified IFN-α2c cytokine, comprising one or more amino acid replacements at one or more target positions in SEQ ID NO:185 (as set forth in FIG. 11) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α2c. In some of these embodiments, the modified IFN-α2c is selected from among proteins comprising one or more single amino acid replacements at one or more target positions in SEQ ID NO: 185 (as set forth in FIG. 11), corresponding to any of amino acid positions: 41, 58, 78, 107, 117, 125, 133 and 159, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α2c variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α2c variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-αd cytokine, comprising one or more amino acid replacements at one or more target positions in SEQ ID NO:186 (as set forth in FIG. 12) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-αd. In some of these embodiments, the modified IFN-αd is selected from among proteins comprising one or more single amino acid replacements at one or more target positions in SEQ ID NO: 186 (as set forth in FIG. 12), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-αd variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-αd variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-α5 cytokine, comprising one or more amino acid replacements at one or more target positions in SEQ ID NO:187 (as set forth in FIG. 13) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α5. In some of these embodiments, the modified IFN-α5 is selected from among proteins comprising one or more single amino acid replacements at one or more target positions in SEQ ID NO: 187 (as set forth in FIG. 13), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α5 variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α5 variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-α6 cytokine, comprising one or more amino acid replacements at one or more target positions in SEQ ID NO:188 (as set forth in FIG. 14) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α6. In some of these embodiments, the modified IFN-α6 is selected from among proteins comprising one or more single amino acid replacements at one or more target positions in SEQ ID NO: 188 (as set forth in FIG. 14), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α6 variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α6 variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α polypeptide variant is a modified IFN-α4 cytokine, comprising one or more amino acid replacements at one or more target positions in SEQ ID NO:189 (as set forth in FIG. 15) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α4. In some of these embodiments, the modified IFN-α4 is selected from among proteins comprising one or more single amino acid replacements at one or more target positions in SEQ ID NO: 189 (as set forth in FIG. 15), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α4 variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α4 variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-α4b cytokine, comprising one or more amino acid replacements at one or more target positions in SEQ ID NO:190 (as set forth in FIG. 16) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α4b. In some of these embodiments, the modified IFN-α4b is selected from among proteins comprising one or more single amino acid replacements at one or more target positions in SEQ ID NO: 190 (as set forth in FIG. 16), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α4b variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α4b variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-αI cytokine, comprising one or more amino acid replacements at one or more target positions in SEQ ID NO:191 (as set forth in FIG. 17) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-αI. In some of these embodiments, the modified IFN-αI is selected from among proteins comprising one or more single amino acid replacements at one or more target positions in SEQ ID NO: 191 (as set forth in FIG. 17), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-αI variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-αI variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-αJ cytokine, comprising one or more amino acid replacements at one or more target positions in SEQ ID NO:192 (as set forth in FIG. 18) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-αJ. In some of these embodiments, the modified IFN-αJ is selected from among proteins comprising one or more single amino acid replacements at one or more target positions in SEQ ID NO: 192 (as set forth in FIG. 18), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-αJ variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-αJ variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-αH cytokine, comprising one or more amino acid replacements at one or more target positions in SEQ ID NO:193 (as set forth in FIG. 19) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-αH. In some of these embodiments, the modified IFN-αH is selected from among proteins comprising one or more single amino acid replacements at one or more target positions in SEQ ID NO: 193 (as set forth in FIG. 19), corresponding to any of amino-acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-αH variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-αH variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-αF cytokine, comprising one or more amino acid replacements at one or more target positions in SEQ ID NO:194 (as set forth in FIG. 20) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-αF. In some of these embodiments, the modified IFN-αF is selected from among proteins comprising one or more single amino acid replacements at one or more target positions in SEQ ID NO: 194 (as set forth in FIG. 20), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-αF variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-αF variants has increased biological activity compared to the unmodified (parent) cytokine, after incubation with either a mixture of proteases, individual proteases, blood lysate, or serum, as described above.

In other embodiments, the hyperglycosylated, protease-resistant IFN-α variant is a modified IFN-α8 cytokine, comprising one or more amino acid replacements at one or more target positions in SEQ ID NO:195 (as set forth in FIG. 21) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-α8. In some of these embodiments, the modified IFN-α8 is selected from among proteins comprising one or more single amino acid replacements at one or more target positions in SEQ ID NO: 195 (as set forth in FIG. 21), corresponding to any of amino acid positions: 41, 59, 79, 108, 118, 126, 138 and 160, or to any of amino acid positions: 27, 33, 41, 59, 79, 90, 108, 110, 111, 112, 114, 118, 122, 126, 138, and 160; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-α8 variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-α8 variants has increased biological activity compared to the unmodified (parent) cytokine, after incubation with either a mixture of proteases, individual proteases, blood lysate, or serum, as described above.

Consensus IFN-α Polypeptide Variants

In other embodiments, the hyperglycosylated, protease-resistant IFN-α variant is a modified consensus IFN-α cytokine, comprising one or more amino acid replacements at one or more target positions in SEQ ID NO:232 (as set forth in FIG. 9) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified consensus IFN-α. In some of these embodiments, the modified consensus IFN-α is selected from among proteins comprising one or more single amino acid replacements at one or more target positions in SEQ ID NO: 232 (as set forth in FIG. 9), corresponding to any of amino acid positions: 42, 59, 79, 108, 118, 126, 134 and 160, or to any of amino acid positions: 27, 33, 42, 60, 80, 91, 109, 111, 112, 113, 115, 119, 123, 127, 135, and 161; where the variant further comprises an amino acid sequence that differs from the amino acid sequence of the parent polypeptide to the extent that the variant comprises one or more glycosylation sites not found in the parent polypeptide.

In some embodiments, any of the above-described consensus IFN-α variants is an [D102N]interferon alfacon-1 glycopeptide, where the [D102N]interferon alfacon-1 glycopeptide is a variant of the interferon alfacon-1 polypeptide having (a) an asparagine residue substituted for the native aspartic acid residue at amino acid position 102 in the amino acid sequence of Infergen (interferon alfacon-1) corresponds to the native aspartic acid residue at amino acid position 99 depicted in FIG. 24 (where the amino acid position is as set forth in FIG. 24; and where D99 in FIG. 24 corresponds to D72 in FIG. 9); and (b) a carbohydrate moiety covalently attached to the R-group of said asparagine residue.

In some embodiments, any of the above-described consensus IFN-α variants is an [D102N, D108N]interferon alfacon-1 glycopeptide, where the [D102N, D108N]interferon alfacon-1 glycopeptide is a variant of the interferon alfacon-1 polypeptide having (a) an asparagine residue substituted for each of the native aspartic acid residues at amino acid positions 102 and 108 in the amino acid sequence of Infergen corresponding to the native aspartic acid residues at amino acid positions 99 and 105, respectively, depicted in FIG. 24 (where the amino acid positions are as set forth in FIG. 24; and where D99 and D105 in FIG. 24 correspond to D72 and D78, respectively, in FIG. 9); and (b) a carbohydrate moiety covalently attached to the R-group of each of said asparagine residues.

In some embodiments, any of the above-described consensus IFN-α variants is an [D102N, D108N, E138N]interferon alfacon-1 glycopeptide, where the [D102N, D108N, E138N] interferon alfacon-1 glycopeptide is a variant of the interferon alfacon-1 polypeptide having (a) an asparagine residue substituted for each of the native aspartic acid, aspartic acid, and glutamic acid residues at amino acid positions 102, 108 and 138, corresponding to the native aspartic acid, aspartic acid, and glutamic acid residues at amino acid positions 99, 105, and 134, respectively, in the amino acid sequence of Infergen depicted in FIG. 24 (where the amino acid positions are as set forth in FIG. 24; and where D99, D105, and E134 in FIG. 24 correspond to D72, D78, and E107, respectively, in FIG. 9); and (b) a carbohydrate moiety covalently attached to the R-group of each of said asparagine residues.

In some embodiments, any of the above-described consensus IFN-α variants is an [D102N, E138N]interferon alfacon-1 glycopeptide, where the [D102N, E138N] interferon alfacon-1 glycopeptide is a variant of the interferon alfacon-1 polypeptide having (a) an asparagine residue substituted for each of the native aspartic acid and glutamic acid residues at amino acid positions 102 and 138, corresponding to the native aspartic acid residue at amino acid position 99 and the native glutamic acid residue at amino acid position 134, respectively, in the amino acid sequence of Infergen depicted in FIG. 24 (where the amino acid positions are as set forth in FIG. 24; and where D99 and E134 in FIG. 24 correspond to D72 and E107, respectively, in FIG. 9); and (b) a carbohydrate moiety covalently attached to the R-group of each of said asparagine residues.

In some embodiments, any of the above-described consensus IFN-α variants is an [D108N, E138N]interferon alfacon-1 glycopeptide, where the [D108N, E138N] interferon alfacon-1 glycopeptide is a variant of the interferon alfacon-1 polypeptide having (a) an asparagine residue substituted for each of the native aspartic acid and glutamic acid residues at amino acid positions 108 and 138, corresponding to the native aspartic acid residues at amino acid positions 105 and the native glutamic acid residue at position 134, respectively, in the amino acid sequence of Infergen depicted in FIG. 24 (where the amino acid positions are as set forth in FIG. 24; and where D105 and E134 in FIG. 24 correspond to D78 and E107, respectively, in FIG. 9); and (b) a carbohydrate moiety covalently attached to the R-group of each of said asparagine residues.

In some embodiments, any of the above-described consensus IFN-α variants is an [D102N, D108N, E138T]interferon alfacon-1 glycopeptide, where the [D102N, D108N, E138T] interferon alfacon-1 glycopeptide is a variant of the interferon alfacon-1 polypeptide having (a) an asparagine residue substituted for each of the native aspartic acid residues at amino acid positions 102 and 108 in the amino acid sequence of Infergen corresponding to the native aspartic acid residues at amino acid positions 99 and 105 depicted in FIG. 24 (b) a threonine residue substituted for the native glutamic acid residue at amino acid position 138 in the amino acid sequence of Infergen corresponding to the native glutamic acid residue at amino acid position 134 depicted in FIG. 24 (where the amino acid positions are as set forth in FIG. 24; and where D99, D105, and E134 in FIG. 24 correspond to D72, D78, and E107, respectively, in FIG. 9); and (c) a carbohydrate moiety covalently attached to the R-group of each of said asparagine and threonine residues.

In some embodiments, any of the above-described consensus IFN-α variants is an [D102N, E138T]interferon alfacon-1 glycopeptide, where the [D102N, E138T]interferon alfacon-1 glycopeptide is a variant of the interferon alfacon-1 polypeptide having (a) an asparagine residue substituted for the native aspartic acid residue at amino acid position 102 in the amino acid sequence of Infergen corresponding to the native aspartic acid residue at amino acid positions 99 depicted in FIG. 24 (b) a threonine residue substituted for the native glutamic acid residue at amino acid position 138 in the amino acid sequence of Infergen corresponds to the native glutamic acid residue at amino acid position 134 depicted in FIG. 24 (where the amino acid positions are as set forth in FIG. 24; and where D99 and E134 in FIG. 24 correspond to D72 and E107, respectively, in FIG. 9); and (c) a carbohydrate moiety covalently attached to the R-group of each of said asparagine and threonine residues.

In some embodiments, any of the above-described consensus IFN-α variants is an [D108N, E138T]interferon alfacon-1 glycopeptide, where the [D108N, E138T]interferon alfacon-1 glycopeptide is a variant of the interferon alfacon-1 polypeptide having (a) an asparagine residue substituted for the native aspartic acid residue at amino acid position 108 in the amino acid sequence of Infergen corresponding to the native aspartic acid residue at amino acid positions 105 depicted in FIG. 24 (b) a threonine residue substituted for the native glutamic acid residue at amino acid position 138 in the amino acid sequence of Infergen corresponding to the native glutamic acid residue at amino acid position 134 depicted in FIG. 24 (where the amino acid positions are as set forth in FIG. 24; and where D105 and E134 in FIG. 24 correspond to D78 and E107, respectively, in FIG. 9); and (c) a carbohydrate moiety covalently attached to the R-group of each of said asparagine and threonine residues.

Hybrid Type I Interferon Receptor Polypeptide Agonists

As used herein, a "hybrid Type I interferon receptor polypeptide agonist" is a polypeptide having an amino acid sequence comprising discrete sub-sequences corresponding in amino acid identity and number to sub-sequences of different, naturally occurring Type I interferon receptor polypeptide agonists, wherein the amino acid sequence of the subject polypeptide agonist differs from that of any naturally-occurring Type I interferon receptor polypeptide agonist. In some embodiments, the polypeptide variant is composed of discrete sub-sequences selected from IFN-α2b, IFN-α14, IFN-β1, and IFN-ω, and the amino acid sequence of the polypeptide variant agonist differs from the amino acid sequences of IFN-α2b, IFN-α14, IFN-β1, and IFN-ω. In other embodiments, the polypeptide variant is composed of discrete sub-sequences selected from IFN-α2b, IFN-α14, IFN-β1, Infergen® consensus IFN-α, and IFN-ω, and the amino acid sequence of polypeptide variant differs from the amino acid sequences of IFN-α2b, IFN-α14, IFN-β1, Infergen® consensus IFN-α, and IFN-ω.

Suitable protease-resistant or protease-resistant, hyperglycosylated polypeptide variants include protease-resistant or protease-resistant, hyperglycosylated forms of any parent hybrid Type I interferon receptor polypeptide agonist. In one aspect, a protease-resistant or protease-resistant, hyperglycosylated variant of a parent hybrid Type I interferon receptor polypeptide agonist has an amino acid sequence that differs from the amino acid sequence of the parent polypeptide to the extent that the variant comprises one or more glycosylation sites not found in the parent polypeptide; and comprises at least one mutated protease cleavage site in place of a native protease cleavage site found in the parent polypeptide.

In one aspect, the parent hybrid Type I interferon receptor polypeptide agonist is [D102N]IFN-α2a glycopeptide, where the [D102N]IFN-α2a glycopeptide is a variant of IFN-α2a having an asparagine residue in place of the native aspartic acid residue at amino acid position 102 in the amino acid sequence of IFN-α2a; and the hyperglycosylated or protease-resistant, hyperglycosylated polypeptide variant of the parent polypeptide is a [D102N, D108N]IFN-α2a glycopeptide, where [D102N, D108N]IFN-α2a glycopeptide is a variant of IFN-α2a having (a) an asparagine residue in place of the native aspartic acid residue at each of amino acid positions 102 and 108 in the amino acid sequence of IFN-α2a (where the D102 and D105 amino acid positions correspond to the D99 and D105 positions as set forth in FIG. 24; and correspond to D71 and D77, respectively, of the amino acid sequence of IFN-α2a set forth in FIG. 1); and (b) a carbohydrate moiety covalently attached to the R-group of each of said asparagine residues; and comprises at least one mutated protease cleavage site in place of a native protease cleavage site found in the parent polypeptide. It will be appreciated that the amino acid sequence of IFN-α2a is the same as the amino acid sequence of IFN-α2b depicted in FIG. 24, provided that the IFN-α2a sequence has a lysine residue in place of the arginine residue at amino acid position 50 in the IFN-α2b sequence shown in FIG. 24 (corresponding to R50 of the IFN-α2b sequence set forth in FIG. 2).

In another aspect, the parent hybrid Type I interferon receptor polypeptide agonist is [D102N]IFN-α2b glycopeptide, where the [D102N]IFN-α2b glycopeptide is a variant of IFN-α2b having an asparagine residue in place of the native aspartic acid residue at amino acid position 102 in the amino acid sequence of IFN-α2b corresponding to the native aspartic acid residue at amino acid position 99 in the amino acid sequence depicted in FIG. 24; and the hyperglycosylated or protease-resistant, hyperglycosylated polypeptide variant of the parent polypeptide is a [D102N, D108N]IFN-α2b glycopeptide, where the [D102N, D108N]IFN-α2b glycopeptide is a variant of IFN-α2b having (a) an asparagine residue in place of the native aspartic acid residue at each of amino acid positions 102 and 108 in the amino acid sequence of IFN-α2b corresponding to the native aspartic acid residues at amino acid positions 99 and 105 in the amino acid sequence depicted in FIG. 24 (where the D99 and D105 amino acid positions are as set forth in FIG. 24; and corresponds to D71 and D77, respectively, of the amino acid sequence of IFN-α2b set forth in FIG. 2); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the hyperglycosylated or protease-resistant, hyperglycosylated polypeptide variant of the parent polypeptide is an [D102N]interferon alfacon-1 glycopeptide, where the [D102N]interferon alfacon-1 glycopeptide is a variant of the interferon alfacon-1 polypeptide having (a) an asparagine residue substituted for the native aspartic acid residue at amino acid position 102 corresponding to the native aspartic acid residue at amino acid position 99 in the amino acid sequence of Infergen depicted in FIG. 24 (where the D99 amino acid position is as set forth in FIG. 24; and corresponds to D72 of the amino acid sequence of consensus IFN-α set forth in FIG. 9); and (b) a carbohydrate moiety covalently attached to the R-group of said asparagine residue; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D 102N, D108N]interferon alfacon-1 glycopeptide, where the [D102N, D108N]interferon alfacon-1 glycopeptide is a variant of the interferon alfacon-1 polypeptide having (a) an asparagine residue substituted for each of the native aspartic acid residues at amino acid positions 102 and 108 in the amino acid sequence of Infergen corresponding to the native aspartic acid residues at amino acid positions 99 and 105 depicted in FIG. 24 (where the D99 and D105 amino acid positions are as set forth in FIG. 24; and correspond to D72 and D78, respectively, of the amino acid sequence of consensus IFN-α set forth in FIG. 9); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D102N, D108N, E138N]interferon alfacon-1 glycopeptide, where the [D102N, D108N, E138N]interferon alfacon-1 glycopeptide is a variant of the interferon alfacon-1 polypeptide having (a) an asparagine residue substituted for each of the native aspartic acid, aspartic acid, and glutamic acid residues at amino acid positions 102, 108 and 138, respectively, in the amino acid sequence of Infergen corresponding to the native aspartic acid residues at amino acid positions 99 and 105 and to the native glutamic acid residue at amino acid position 134 depicted in FIG. 24 (where the D99, D105, and E134 amino acid positions are as set forth in FIG. 24; and correspond to D72, D78, and E107, respectively, of the amino acid sequence of consensus IFN-α set forth in FIG. 9); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D102N, E138N] interferon alfacon-1 glycopeptide, where the [D102N, E138N] interferon alfacon-1 glycopeptide is a variant of the interferon alfacon-1 polypeptide having (a) an asparagine residue substituted for each of the native aspartic acid and glutamic acid residues at amino acid positions 102 and 138, respectively, in the amino acid sequence of Infergen corresponding to the native aspartic acid residue at amino acid position 99 and the native glutamic acid residue at position 134 depicted in FIG. 24 (where the D99 and E134 amino acid positions are as set forth in FIG. 24; and correspond to D72 and E107, respectively, of the amino acid sequence of consensus IFN-α set forth in FIG. 9); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D108N, E138N] interferon alfacon-1 glycopeptide, where the [D108N, E138N] interferon alfacon-1 glycopeptide is a variant of the interferon alfacon-1 polypeptide having (a) an asparagine residue substituted for each of the native aspartic acid and glutamic acid residues at amino acid positions 108 and 138, respectively, in the amino acid sequence of Infergen corresponding to the native aspartic acid residue at amino acid position 105 and native glutamic acid resieude at amino acid position 134 depicted in FIG. 24 (where the D105 and E134 amino acid positions are as set forth in FIG. 24; and correspond to D78 and E107, respectively, of the amino acid sequence of consensus IFN-α set forth in FIG. 9); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D102N, D108N, E138T]interferon alfacon-1 glycopeptide, where the [D102N, D108N, E138T]interferon alfacon-1 glycopeptide is a variant of the interferon alfacon-1 polypeptide having (a) an asparagine residue substituted for each of the native aspartic acid residues at amino acid positions 102 and 108 in the amino acid sequence of Infergen corresponding to the native aspartic acid residues at amino acid positions 99 and 105 depicted in FIG. 24; (b) a threonine residue substituted for the native glutamic acid residue at amino acid position 138 in the amino acid sequence of Infergen corresponding to the native glutamic acid residue at amino acid position 134 depicted in FIG. 24 (where the D99, D105, and E134 amino acid positions are as set forth in FIG. 24; and correspond to D72, D78, and E107, respectively, of the amino acid sequence of consensus IFN-α set forth in FIG. 9); and (c) a carbohydrate moiety covalently attached to the R-group of each of said asparagine and threonine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant of the parent polypeptide is an [D102N, E138T]interferon alfacon-1 glycopeptide, where the [D102N, E138T]interferon alfacon-1 glycopeptide is a variant of the interferon alfacon-1 polypeptide having (a) an asparagine residue substituted for the native aspartic acid residue at amino acid position 102 in the amino acid sequence of Infergen corresponding to the native aspartic acid residue at amino acid position 99 depicted in FIG. 24; (b) a threonine residue substituted for the native glutamic acid residue at amino acid position 138 in the amino acid sequence of Infergen corresponding to the native glutamic acid residue at amino acid position 134 depicted in FIG. 24 (where the D99 and E134 amino acid positions are as set forth in FIG. 24; and correspond to D72 and E107, respectively, of the amino acid sequence of consensus IFN-α set forth in FIG. 9); and (c) a carbohydrate moiety covalently attached to the R-group of each of said asparagine and threonine residues; and comprises at least one mutated protease cleavage site in place of a native protease cleavage site found in the parent polypeptide.

In another aspect, the parent hybrid Type I interferon receptor polypeptide agonist is the interferon alfacon-1 polypeptide; and the protease-resistant or protease-resistant, hyperglycosylated polypeptide variant is an [D108N, E138T] interferon alfacon-1 glycopeptide, where the [D108N, E138T]interferon alfacon-1 glycopeptide is a variant of the interferon alfacon-1 polypeptide having (a) an asparagine residue substituted for the native aspartic acid residue at amino acid position 108 in the amino acid sequence of Infergen corresponding to the native aspartic acid residue at amino acid position 105 depicted in FIG. 24; (b) a threonine residue substituted for the native glutamic acid residue at amino acid position 138 in the amino acid sequence of Infergen corresponding to the native glutamic acid residue at amino acid position 134 depicted in FIG. 24 (where the D105 and E134 amino acid positions are as set forth in FIG. 24; and correspond to D78 and E107, respectively, of the amino acid sequence of consensus IFN-α set forth in FIG. 9); and (c) a carbohydrate moiety covalently attached to the R-group of each of said asparagine and threonine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hypeglycosylated or protease-resistant, hyperglycosylated polypeptide variant of the parent polypeptide is a [D102N] "majority" consensus Type I interferon glycopeptide, where the [D102N]"majority" consensus Type I interferon glycopeptide is the "majority" amino acid sequence depicted in FIG. 24 having (a) an asparagine residue substituted for the native aspartic acid residue at amino acid position 102 corresponding to the native aspartic acid residue at amino acid position 99 in the "majority" amino acid sequence and (b) a carbohydrate moiety covalently attached to the R-group of said asparagine residue; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D102N, D108N]"majority" consensus Type I interferon glycopeptide, where the [D102N, D108N]"majority" consensus Type I interferon glycopeptide is the "majority" amino acid sequence depicted in FIG. 24 having (a) an asparagine residue substituted for each of the native aspartic acid residues at amino acid positions 102 and 108 corresponding to the native aspartic acid residues at amino acid positions 99 and 105 in the "majority" amino acid sequence and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D102N, D108N, E138N]"majority" consensus Type I interferon glycopeptide, where the [D102N, D108N, E138N]"majority" consensus Type I interferon glycopeptide is the "majority" amino acid sequence depicted in FIG. 24 having (a) an asparagine residue substituted for each of the native aspartic acid, aspartic acid, and glutamic acid residues at amino acid positions 102, 108 and 138, corresponding to the native aspartic acid residues at amino acid positions 99 and 105 and the native glutamic acid residue at amino acid position 134 respectively, in the "majority" amino acid sequence and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D102N, E138N]"majority" consensus Type I interferon glycopeptide, where the [D102N, E138N]"majority" consensus Type I interferon glycopeptide is the "majority" amino acid sequence depicted in FIG. 24 having (a) an asparagine residue substituted for each of the native aspartic acid and glutamic acid residues at amino acid positions 102 and 138, corresponding to the native aspartic acid residue at amino acid position 99 and the native glutamic acid residue at position 134 respectively, in the "majority" amino acid sequence (where the amino acid positions are as set forth in FIG. 24); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D108N, E138N]"majority" consensus Type I interferon glycopeptide, where the [D108N, E138N]"majority" consensus Type I interferon glycopeptide is the "majority" amino acid sequence depicted in FIG. 24 having (a) an asparagine residue substituted for each of the native aspartic acid and glutamic acid residues at amino acid positions 108 and 138, corresponding to the native aspartic acid residue at amino acid position 105 and the native glutamic acid residue at position 134 respectively, in the "majority" amino acid sequence (where the amino acid positions are as set forth in FIG. 24); and (b) a carbohydrate moiety covalently attached to the R-group of each of said asparagine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D102N, D108N, E138T]"majority" consensus Type I interferon glycopeptide, where the [D102N, D108N, E138T]"majority" consensus Type I interferon glycopeptide is the "majority" amino acid sequence depicted in FIG. 24 having (a) an asparagine residue substituted for each of the native aspartic acid residues at amino acid positions 102 and 108 corresponding to the native aspartic acid residues at amino acid positions 99 and 105 in the "majority" amino acid sequence (b) a threonine residue substituted for the native glutamic acid residue at amino acid position 138 corresponding to the native glutamic acid residue at position 134 in the "majority" amino acid sequence and (c) a carbohydrate moiety covalently attached to the R-group of each of said asparagine and threonine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D102N, E138T]"majority" consensus Type I interferon glycopeptide, where the [D102N, E138T]"majority" consensus Type I interferon glycopeptide is the "majority" amino acid sequence depicted in FIG. 24 having (a) an asparagine residue substituted for the native aspartic acid residue at amino acid position 102 corresponding to the native aspartic acid residue at amino acid position 99 in the "majority" amino acid sequence (b) a threonine residue substituted for the native glutamic acid residue at amino acid position 138 corresponding to the native glutamic acid residue at position 134 in the "majority" amino acid sequence and (c) a carbohydrate moiety covalently attached to the R-group of each of said asparagine and threonine residues; and comprises at least one mutated protease cleavage site in place of a native protease cleavage site found in the parent polypeptide.

In another aspect, the parent hybrid Type I interferon receptor polypeptide agonist is the "majority" consensus Type I interferon amino acid sequence depicted in FIG. 24; and the hyperglycosylated or protease-resistant, hyperglycosylated polypeptide variant of the parent polypeptide is a [D108N, E138T]"majority" consensus Type I interferon glycopeptide, where the [D108N, E138T]"majority" consensus Type I interferon glycopeptide is the "majority" amino acid sequence depicted in FIG. 24 having (a) an asparagine residue substituted for the native aspartic acid residue at amino acid position 108 corresponding to the native aspartic acid residue at amino acid position 105 in the "majority" amino acid sequence (b) a threonine residue substituted for the native glutamic acid residue at amino acid position 138 corresponding to the native glutamic acid residue at position 134 in the "majority" amino acid sequence (where the amino acid positions are as set forth in FIG. 24); and (c) a carbohydrate moiety covalently attached to the R-group of each of said asparagine and threonine residues; and comprises at least one mutated protease cleavage site in place of a native protease cleavage site found in the parent polypeptide.

The numbering of amino acid replacements (discussed in the context of generating hyperglycosylation variants of the parent protein therapeutic) used to describe the hyperglycosylated or protease-resistant, hyperglycosylated polypeptide variants of parent hybrid Type I receptor polypeptide agonists herein coincides with the numbering of amino acids used to depict the Type I interferon amino acid sequences as described above and corresponds to the sequence numbering appearing in FIG. 24. Thus, position 102 in the variant [D102N]interferon α2b polypeptide described by SEQ ID No.:1440 corresponds to position 99 as set forth in FIG. 24.

In another aspect, a hyperglycosylated or protease-resistant, hyperglycosylated polypeptide variant of a parent hybrid Type I interferon receptor polypeptide agonist therapeutic differs from the parent hybrid Type I interferon receptor polypeptide agonist therapeutic to the extent that the hyperglycosylated or protease-resistant, hyperglycosylated polypeptide variant comprises (1) a carbohydrate moiety covalently attached to a non-native glycosylation site not found in the parent hybrid Type I interferon receptor polypeptide agonist therapeutic and/or (2) a carbohydrate moiety covalently attached to a native glycosylation site found but not glycosylated in the parent hybrid Type I interferon receptor polypeptide agonist therapeutic.

In some embodiments, any of the above-described hyperglycosylated, protease-resistant consensus IFN-α variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant consensus IFN-α variants has increased biological activity compared to the unmodified (parent) cytokine, after incubation with either a mixture of proteases, individual proteases, blood lysate, or serum, as described above.

IFN-β Polypeptide Variants

In some embodiments, a protease-resistant or protease-resistant, hyperglycosylated cytokine variant is an IFN-β variant. In some embodiments, the protease-resistant or protease-resistant, hyperglycosylated IFN-β variant comprises one or more single amino acid replacements in SEQ ID NO:197 (or the amino acid sequence as set forth in FIG. 3), corresponding to the replacement of one or more of: M by V at position 1, M by I at position 1, M by T at position 1, M by Q at position 1, M by A at position 1, L by V at position 5, L by I at position 5, L by T at position 5, L by Q at position 5, L by H at position 5, L by A at position 5, F by I at position 8, F by V at position 8, L by V at position 9, L by I at position 9, L by T at position 9, L by Q at position 9, L by H at position 9, L by A at position 9, R by H at position 11, R by Q at position 11, F by I at position 15, F by V at position 15, K by Q at position 19, K by T at position 19, K by S at position 19, K by H at position 19, W by S at position 22, W by H at position 22, N by H at position 25, N by S at position 25, N by Q at position 25, R by H position 27, R by Q position 27, L by V at position 28, L by I at position 28, L by T at position 28, L by Q at position 28, L by H at position 28, L by A at position 28, E by Q at position 29, E by H at position 29, Y by H at position 30, Y by I at position 30, L by V at position 32, L by I at position 32, L by T at position 32, L by Q at position 32, L by H at position 32, L by A at position 32, K by Q at position 33, K by T at position 33, K by S at position 33, K by H at position 33, R by H at position 35, R by Q at position 35, M by V at position 36, M by I at position 36, M by T at position 36, M by Q at position 36, M by A at position 36, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by, Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by Q at position 73, D by H at position 73, D by G at position 73, E by Q at position 81, E by H at position 81, E by Q at position 85, E by H at position 85, Y by H at position 92, Y by I at position 92, K by Q at position 102, K by T at position 102, K by S at position 102, K by H at position 102, E by Q at position 103, E by H at position 103, E by Q at position 104, E by H at position 104, K by Q at position 105, K by T at position 105, K by S at position 105, K by H at position 105, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 138, Y by I at position 138, R by H at position 152, R by Q at position 152, Y by H at position 155, Y by I at position 155, R by H at position 159, R by Q at position 159, Y by H at position 163, Y by I at position 163, R by H at position 165, R by Q at position 165, M by D at position 1, M by E at position 1, M by K at position 1, M by N at position 1, M by R at position 1, M by S at position 1, L by D at position 5, L by E at position 5, L by K at position 5, L by N at position 5, L by R at position 5, L by S at position 5, L by D at position 6, L by E at position 6, L by K at position 6, L by N at position 6, L by R at position 6, L by S at position 6, L by Q at position 6, L by T at position 6, F by E at position 8, F by K at position 8, F by R at position 8, F by D at position 8, L by D at position 9, L by E at position 9, L by K at position 9, L by N at position 9, L by R at position 9, L by S at position 9, Q by D at position 10, Q by E at position 10, Q by K at position 10, Q by N at position 10, Q by R at position 10, Q by S at position 10, Q by T at position 10, S by D at position 12, S by E at position 12, S by K at position 12, S by R at position 12, S by D at position 13, S by E at position 13, S by K at position 13, S by R at position 13, S by N at position 13, S by Q at position 13, S by T at position 13, N by D at position 14, N by B at position 14, N by K at position 14, N by Q at position 14, N by R at position 14, N by S at position 14, N by T at position 14, F by D at position 15, F by B at position 15, F by K at position 15, F by R at position 15, Q by D at position 16, Q by E at position 16, Q by K at position 16, Q by N at position 16, Q by R at position 16, Q by S at position 16, Q by T at position 16, C by D at position 17, C by B at position 17, C by K at position 17, C by N at position 17, C by Q at position 17, C by R at position 17, C by S at position 17, C by T at position 17, L by N at position 20, L by Q at position 20, C by R at position 20, C by S at position 20, L by T at position 20, L by D at position 20, L by R at position 20, L by S at position 20, L by T at position 20, L by D at position 20, L by E at position 20, L by K at position 20, W by D at position 22, W by E at position 22, W by K at position 22, W by R at position 22, Q by D at position 23, Q by E at position 23, Q by K at position 23, Q by R at position 23, L by D at position 24, L by E at position 24, L by K at position 24, L by R at position 24, W by D at position 79, W by E at position 79, W by K at position 79, W by R at position 79, N by D at position 80, N by E at position 80, N by K at position 80, N by R at position 80, T by D at position 82, T by E at position 82, T by K at position 82, T by R at position 82, I by D at position 83, I by E at position 83, I by K at position 83, I by R at position 83, N by N at position 83, N by Q at position 83, N by S at position 83, N by T at position 83, N by D at position 86, N by E at position 86, N by K at position 86, N by R at position 86, N by Q at position 86, N by S at position 86, N by T at position 86, L by D at position 87, L by E at position 87, L by K at position 87, L by R at position 87, L by N at position 87, L by Q at position 87, L by S at position 87, L by T at position 87, A by D at position 89, A by E at position 89, A by K at position 89, A by R at position 89, N by D at position 90, N by E at position 90, N by K at position 90, N by Q at position 90, N by R at position 90, N by S at position 90, N by T at position 90, V by D at position 91, V by E at position 91, V by K at position 91, V by N at position 91, V by Q at position 91, V by R at position 91, V by S at position 91, V by T at position 91, Q by D at position 94, Q by E at position 94, Q by Q at position 94, Q by N at position 94, Q by R at position 94, Q by S at position 94, Q by T at position 94, I by D at position 95, I by E at position 95, I by K at position 95, I by N at position 95, I by Q at position 95, I by R at position 95, I by S at position 95, I by T at position 95, H by D at position 97, H by E at position 97, H by K at position 97, H by N at position 97, H by Q at position 97, H by R at position 97, H by S at position 97, H by T at position 97, L by D at position 98, L by E at position 98, L by K at position 98, L by N at position 98, L by Q at position 98, L by R at position 98, L by S at position 98, L by T at position 98, V by D at position 101, V by E at position 101, V by K at position 101, V by N at position 101, V by Q at position 101, V by R at position 101, V by S at position 101, V by T at position 101, M by C at position 1, L by C at position 6, Q by C at position 10, S by C at position 13, Q by C at position 16, L by C at position 17, V by C at position 101, t by C at position 98, H by C at position 97, Q by C at position 94, V by C at position 91, or N by C at position 90, wherein residue 1 corresponds to residue 1 of the mature IFN-β cytokine set forth in SEQ ID NO:197; and further comprises an amino acid sequence that differs from the amino acid sequence of the parent polypeptide to the extent that the variant comprises one or more glycosylation sites not found in the parent polypeptide.

3-D Structural Homologs

In other embodiments, the hyperglycosylated, protease-resistant interferon variant is a modified IFN-β cytokine, comprising one or more amino acid replacements at one or more target positions in SEQ ID NO:197 (as set forth in FIG. 3) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-β. In some of these embodiments, the modified IFN-β is selected from among proteins comprising one or more single amino acid replacements at one or more target positions in SEQ ID NO: 197 (as set forth in FIG. 3), corresponding to any of amino acid positions: 39, 42, 45, 47, 52, 67, 71, 73, 81, 107, 108, 109, 110, 111, 113, 116, 120, 123, 124, 128, 130, 138, 136, 137, 163 and 165, where the mutations include insertions, deletions and replacements of the native amino acid residue(s); where the variant further comprises an amino acid sequence that differs from the amino acid sequence of the parent polypeptide to the extent that the variant comprises one or more glycosylation sites not found in the parent polypeptide.

In other embodiments, the hyperglycosylated, protease-resistant interferon variant is a modified IFN-β cytokine comprising one or more amino acid replacements, where the replacements are selected from amino acid substitutions in SEQ ID NO:197 (as set forth in FIG. 3) corresponding to: D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by H at position 73, D by G at position 73, D by Q at position 73, E by Q at position 81, E by H at position 81, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 163, Y by I at position 1631, R by H at position 165, or R by Q at position 165, wherein the first amino acid listed is substituted by the second at the position indicated; where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-β variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-β variants has increased biological activity compared to the unmodified (parent) cytokine, after incubation with either a mixture of proteases, individual proteases, blood lysate, or serum, as described above.

In other embodiments, the hyperglycosylated, protease-resistant interferon variant is a modified IFN-β1 cytokine, comprising one or more amino acid replacements at one or more target positions in SEQ ID NO:196 (as set forth in FIG. 22) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-β1. In some of these embodiments, the modified IFN-β1 is selected from among proteins comprising one or more single amino acid replacements at one or more target positions in SEQ ID NO: 196 (as set forth in FIG. 22), corresponding to any of amino acid positions: 39, 42, 45, 47, 52, 67, 71, 73, 81, 107, 108, 109, 110, 111, 113, 116, 120, 123, 124, 128, 130, 138, 136, 137, 163 and 165, where the mutations include insertions, deletions and replacements of the native amino acid residue(s); where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant IFN-β1 variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-β1 variants has increased biological activity compared to the unmodified (parent) cytokine, after incubation with either a mixture of proteases, individual proteases, blood lysate, or serum, as described above.

In other embodiments, the protease-resistant interferon variant is a modified IFN-β2a cytokine, comprising one or more amino acid replacements at one or more target positions in SEQ ID NO:198 (as set forth in FIG. 23) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-β2a. In some of these embodiments, the modified IFN-β2a is selected from among proteins comprising one or more single amino acid replacements at one or more target positions in SEQ ID NO: 198 (as set forth in FIG. 23), corresponding to any of amino acid positions: 39, 42, 45, 47, 52, 67, 71, 73, 81, 107, 108, 109, 110, 111, 113, 116, 120, 123, 124, 128, 130, 138, 136, 137, 163 and 165, where the mutations include insertions, deletions and replacements of the native amino acid residue(s); where the variant further comprises an amino acid sequence that differs from the amino acid sequence of the parent polypeptide to the extent that the variant comprises one or more glycosylation sites not found in the parent polypeptide.

In some embodiments, any of the above-described hyperglycosylated, protease-resistant polypeptide IFN-β2a variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described hyperglycosylated, protease-resistant IFN-β2a variants has increased biological activity compared to the unmodified (parent) cytokine, after incubation with either a mixture of proteases, individual proteases, blood lysate, or serum, as described above.

In another aspect, the present invention provides a cytokine structural homolog of any of the above-described protease-resistant IFN-β variants, where the homolog comprises one or more amino acid replacements at positions corresponding to the 3-dimentional-structurally-similar modified positions within the 3-dimensional structure of the modified IFN-β. In many embodiments, the homolog has increased resistance to proteolysis compared to its unmodified cytokine counterpart, wherein the resistance to proteolysis is measured by mixture with a protease in vitro, incubation with blood, or incubation with serum. In many embodiments, the cytokine is an IFN-β cytokine.

In another aspect, the present invention provides a modified IFN-β cytokine (e.g., a hyperglycosylated, protease-resistant IFN-β variant), comprising one or more amino acid replacements at one or more target positions in SEQ ID NO. 197 (the amino acid sequence set forth in FIG. 3) corresponding to a structurally-related modified amino acid position within the 3-dimensional structure of any of the above-described IFN-β modified cytokines, where the replacements lead to greater resistance to proteases, as assessed by incubation with a protease or a with a blood lysate or by incubation with serum, compared to the unmodified IFN-β.

In some embodiments, any of the above-described hyperglycosylated, protease-resistant IFN-β variants has increased stability compared to the unmodified (parent) cytokine, where the stability is assessed by measuring residual biological activity to either inhibit viral replication or to stimulate cell proliferation in appropriate cells, after incubation with either a mixture of proteases, individual proteases, blood lysate, or serum, as described above.

In some embodiments, any of the above-described hyperglycosylated, protease-resistant IFN-β variants has increased biological activity compared to the unmodified (parent) cytokine, where the activity is assessed by the capacity to either inhibit viral replication in appropriate cells, or to inhibit cell proliferation in appropriate cells, after incubation with either a mixture of proteases, individual proteases, blood lysate, or serum, as described above.

In some embodiments, a hyperglycosylated, protease-resistant IFN-β variant (a "modified IFN-β cytokine") is selected from the group of proteins comprising one or more single amino acid replacements in SEQ ID NO:197, as set forth in FIG. 3, corresponding to the replacement of: M by V at position 1, M by I at position 1, M by T at position 1, M by Q at position 1, M by A at position 1, L by V at position 5, L by I at position 5, L by T at position 5, L by Q at position 5, L by H at position 5, L by A at position 5, F by I at position 8, F by V at position 8, L by V at position 9, L by I at position 9, L by T at position 9, L by Q at position 9, L by H at position 9, L by A at position 9, R by H at position 11, R by Q at position 11, F by I at position 15, F by V at position 15, K by Q at position 19, K by T at position 19, K by S at position 19, K by H at position 19, W by S at position 22, W by H at position 22, N by H at position 25, N by S at position 25, N by Q at position 25, R by H position 27, R by Q position 27, L by V at position 28, L by I at position 28, L by T at position 28, L by Q at position 28, L by H at position 28, L by A at position 28, E by Q at position 29, E by H at position 29, Y by H at position 30, Y by I at position 30, L by V at position 32, L by I at position 32, L by T at position 32, L by Q at position 32, L by H at position 32, L by A at position 32, K by Q at position 33, K by T at position 33, K by S at position 33, K by H at position 33, R by H at position 35, R by Q at position 35, M by V at position 36, M by I at position 36, M by T at position 36, M by Q at position 36, M by A at position 36, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by, Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by Q at position 73, D by H at position 73, D by G at position 73, E by Q at position 81, E by H at position 81, E by Q at position 85, E by H at position 85, Y by H at position 92, Y by I at position 92, K by Q at position 102, K by T at position 102, K by S at position 102, K by H at position 102, E by Q at position 103, E by H at position 103, E by Q at position 104, E by H at position 104, K by Q at position 105, K by T at position 105, K by S at position 105, K by H at position 105, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by Y at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 138, Y by I at position 138, R by H at position 152, R by Q at position 152, Y by H at position 155, Y by I at position 155, R by H at position 159, R by Q at position 159, Y by H at position 163, Y by I at position 163, R by H at position 165, R by Q at position 165, M by D at position 1, M by E at position 1, M by K at position 1, M by N at position 1, M by R at position 1, M by S at position 1, L by D at position 5, L by E at position 5, L by K at position 5, L by N at position 5, L by R at position 5, L by S at position 5, L by D at position 6, L by E at position 6, L by K at position 6, L by N at position 6, L by R at position 6, L by S at position 6, L by Q at position 6, L by T at position 6, F by E at position 8, F by K at position 8, F by R at position 8, F by D at position 8, L by D at position 9, L by E at position 9, L by K at position 9, L by N at position 9, L by R at position 9, L by S at position 9, Q by D at position 10, Q by E at position 10, Q by K at position 10, Q by N at position 10, Q by R at position 10, Q by S at position 10, Q by T at position 10, S by D at position 12, S by E at position 12, S by K at position 12, S by R at position 12, S by D at position 13, S by E at position 13, S by K at position 13, S by R at position 13, S by N at position 13, S by Q at position 13, S by T at position 13, N by D at position 14, N by E at position 14, N by K at position 14, N by Q at position 14, N by R at position 14, N by S at position 14, N by T at position 14, F by D at position 15, F by E at position 15, F by K at position 15, F by R at position 15, Q by D at position 16, Q by E at position 16, Q by K at position 16, Q by N at position 16, Q by R at position 16, Q by S at position 16, Q by T at position 16, C by D at position 17, C by E at position 17, C by K at position 17, C by N at position 17, C by Q at position 17, C by R at position 17, C by S at position 17, C by T at position 17, L by N at position 20, L by Q at position 20, L by R at position 20, L by S at position 20, L by T at position 20, L by D at position 20, L by E at position 20, L by K at position 20, W by D at position 22, W by E at position 22, W by K at position 22, W by R at position 22, Q by D at position 23, Q by E at position 23, Q by K at position 23, Q by R at position 23, L by D at position 24, L by E at position 24, L by K at position 24, L by R at position 24, W by D at position 79, W by E at position 79, W by K at position 79, W by R at position 79, N by D at position 80, N by E at position 80, N by K at position 80, N by R at position 80, T by D at position 82, T by E at position 82, T by K at position 82, T by R at position 82, I by D at position 83, I by E at position 83, I by K at position 83, I by R at position 83, I by N at position 83, I by Q at position 83, I by S at position 83, I by T at position 83, N by D at position 86, N by E at position 86, N by K at position 86, N by R at position 86, N by Q at position 86, N by S at position 86, N by T at position 86, L by D at position 87, L by E at position 87, L by K at position 87, L by R at position 87, L by N at position 87, L by Q at position 87, L by S at position 87, L by T at position 87, A by D at position 89, A by E at position 89, A by K at position 89, A by R at position 89, N by D at position 90, N by E at position 90, N by K at position 90, N by Q at position 90, N by R at position 90, N by S at position 90, N by T at position 90, V by D at position 91, V by E at position 91, V by K at position 91, V by N at position 91, V by Q at position 91, V by R at position 91, V by S at position 91, V by T at position 91, Q by D at position 94, Q by E at position 94, Q by Q at position 94, Q by N at position 94, Q by R at position 94, Q by S at position 94, Q by T at position 94, I by D at position 95, I by E at position 95, I by K at position 95, I by N at position 95, I by Q at position 95, I by R at position 95, I by S at position 95, I by T at position 95, H by D at position 97, H by E at position 97, H by K at position 97, H by N at position 97, H by Q at position 97, H by R at position 97, H by S at position 97, H by T at position 97, L by D at position 98, L by E at position 98, L by K at position 98, L by N at position 98, L by Q at position 98, L by R at position 98, L by S at position 98, L by T at position 98, V by D at position 101, V by E at position 101, V by K at position 101, V by N at position 101, V by Q at position 101, V by R at position 101, V by S at position 101, V by T at position 101, M by C at position 1, L by C at position 6, Q by C at position 10, S by C at position 13, Q by C at position 16, L by C at position 17, V by C at position 101, L by C at position 98, H by C at position 97, Q by C at position 94, V by C at position 91, or N by C at position 90, or any combination of such replacements, wherein residue 1 corresponds to residue 1 of the mature IFN-β. cytokine set forth in SEQ ID NO:197 (as set forth in FIG. 3); where the variant further comprises an amino acid sequence that differs from the amino acid sequence of the parent polypeptide to the extent that the variant comprises one or more glycosylation sites not found in the parent polypeptide.

In other embodiments, a hyperglycosylated, protease-resistant IFN-β variant (a "modified IFN-β cytokine") is selected from the group of proteins comprising one or more single amino acid replacements in SEQ ID NO:197, as set forth in FIG. 3, corresponding to the replacement of: D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by H at position 73, D by G at position 73, D by Q at position 73, E by Q at position 81, E by H at position 81, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 163, Y by I at position 1631, R by H at position 165, or R by Q at position 165, or any combination of such replacements, wherein the first amino acid listed is substituted by the second at the position indicated; where the variant further comprises an amino acid sequence that differs from the amino acid sequence of the parent polypeptide to the extent that the variant comprises one or more glycosylation sites not found in the parent polypeptide.

In some embodiments, a hyperglycosylated, protease-resistant IFN-β variant (a "modified IFN-β cytokine") is selected from the group of proteins comprising one or more single amino acid replacements in SEQ ID NO: 197, as set forth in FIG. 3, corresponding to the replacement of: M by V at position 1, M by I at position 1, M by T at position 1, M by Q at position 1, M by A at position 1, L by V at position 5, L by I at position 5, L by T at position 5, L by Q at position 5, L by H at position 5, L by A at position 5, F by I at position 8, F by V at position 8, L by V at position 9, L by I at position 9, L by T at position 9, L by Q at position 9, L by H at position 9, L by A at position 9, R by H at position 11, R by Q at position 11, F by I at position 15, F by V at position 15, K by Q at position 19, K by T at position 19, K by S at position 19, K by H at position 19, W by S at position 22, W by H at position 22, N by H at position 25, N by S at position 25, N by Q at position 25, R by H position 27, R by Q position 27, L by V at position 28, L by I at position 28, L by T at position 28, L by Q at position 28, L by H at position 28, L by A at position 28, E by Q at position 29, E by H at position 29, Y by H at position 30, Y by I at position 30, L by V at position 32, L by I at position 32, L by T at position 32, L by Q at position 32, L by H at position 32, L by A at position 32, K by Q at position 33, K by T at position 33, K by S at position 33, K by H at position 33, R by H at position 35, R by Q at position 35, M by V at position 36, M by I at position 36, M by T at position 36, M by Q at position 36, M by A at position 36, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by, Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by Q at position 73, D by H at position 73, D by G at position 73, E by Q at position 81, E by H at position 81, E by Q at position 85, E by H at position 85, Y by H at position 92, Y by I at position 92, K by Q at position 102, K by T at position 102, K by S at position 102, K by H at position 102, E by Q at position 103, E by H at position 103, E by Q at position 104, E by H at position 104, K by Q at position 105, K by T at position 105, K by S at position 105, K by H at position 105, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 138, Y by I at position 138, R by H at position 152, R by Q at position 152, Y by H at position 155, Y by I at position 155, R by H at position 159, R by Q at position 159, Y by H at position 163, Y by I at position 163, R by H at position 165, R by Q at position 165, M by D at position 1, M by E at position 1, M by K at position 1, M by N at position 1, M by R at position 1, M by S at position 1, L by D at position 5, L by E at position 5, L by K at position 5, L by N at position 5, L by R at position 5, L by S at position 5, L by D at position 6, L by E at position 6, L by K at position 6, L by N at position 6, L by R at position 6, L by S at position 6, L by Q at position 6, L by T at position 6, F by E at position 8, F by K at position 8, F by R at position 8, F by D at position 8, L by D at position 9, L by E at position 9, L by K at position 9, L by N at position 9, L by R at position 9, L by S at position 9, Q by D at position 10, Q by E at position 10, Q by K at position 10, Q by N at position 10, Q by R at position 10, Q by S at position 10, Q by T at position 10, S by D at position 12, S by E at position 12, S by K at position 12, S by R at position 12, S by D at position 13, S by E at position 13, S by K at position 13, S by R at position 13, S by N at position 13, S by Q at position 13, S by T at position 13, N by D at position 14, N by E at position 14, N by K at position 14, N by Q at position 14, N by R at position 14, N by S at position 14, N by T at position 14, F by D at position 15, F by E at position 15, F by K at position 15, F by R at position 15, Q by D at position 16, Q by E at position 16, Q by K at position 16, Q by N at position 16, Q by R at position 16, Q by S at position 16, Q by T at position 16, C by D at position 17, C by E at position 17, C by K at position 17, C by N at position 17, C by Q at position 17, C by R at position 17, C by S at position 17, C by T at position 17, L by N at position 20, L by Q at position 20, L by R at position 20, L by S at position 20, L by T at position 20, L by D at position 20, L by E at position 20, L by K at position 20, W by D at position 22, W by E at position 22, W by K at position 22, W by R at position 22, Q by D at position 23, Q by E at position 23, Q by K at position 23, Q by R at position 23, L by D at position 24, L by E at position 24, L by K at position 24, L by R at position 24, W by D at position 79, W by E at position 79, W by K at position 79, W by R at position 79, N by D at position 80, N by E at position 80, N by K at position 80, N by R at position 80, T by D at position 82, T by E at position 82, T by K at position 82, T by R at position 82, I by D at position 83, I by E at position 83, I by K at position 83, I by R at position 83, I by N at position 83, I by Q at position 83, I by S at position 83, I by T at position 83, N by D at position 86, N by E at position 86, N by K at position 86, N by R at position 86, N by Q at position 86, N by S at position 86, N by T at position 86, L by D at position 87, L by E at position 87, L by K at position 87, L by R at position 87, L by N at position 87, L by Q at position 87, L by S at position 87, L by T at position 87, A by D at position 89, A by E at position 89, A by K at position 89, A by R at position 89, N by D at position 90, N by E at position 90, N by K at position 90, N by Q at position 90, N by R at position 90, N by S at position 90, N by T at position 90, V by D at position 91, V by E at position 91, V by K at position 91, V by N at position 91, V by Q at position 91, V by R at position 91, V by S at position 91, V by T at position 91, Q by D at position 94, Q by E at position 94, Q by Q at position 94, Q by N at position 94, Q by R at position 94, Q by S at position 94, Q by T at position 94, I by D at position 95, I by E at position 95, I by K at position 95, I by N at position 95, I by Q at position 95, I by R at position 95, I by S at position 95, I by T at position 95, H by D at position 97, H by E at position 97, H by K at position 97, H by N at position 97, H by Q at position 97, H by R at position 97, H by S at position 97, H by T at position 97, L by D at position 98, L by E at position 98, L by K at position 98, L by N at position 98, L by Q at position 98, L by R at position 98, L by S at position 98, L by T at position 98, V by D at position 101, V by E at position 101, V by K at position 101, V by N at position 101, V by Q at position 101, V by R at position 101, V by S at position 101, V by T at position 101, M by C at position 1, L by C at position 6, Q by C at position 10, S by C at position 13, Q by C at position 16, L by C at position 17, V by C at position 101, L by C at position 98, H by C at position 97, Q by C at position 94, V by C at position 91, N by C at position 90, D by Q at position 39, D by H at position 39, D by G at position 39, E by Q at position 42, E by H at position 42, K by Q at position 45, K by T at position 45, K by S at position 45, K by H at position 45, L by V at position 47, L by I at position 47, L by T at position 47, L by Q at position 47, L by H at position 47, L by A at position 47, K by Q at position 52, K by T at position 52, K by S at position 52, K by H at position 52, F by I at position 67, F by V at position 67, R by H at position 71, R by Q at position 71, D by H at position 73, D by G at position 73, D by Q at position 73, E by Q at position 81, E by H at position 81, E by Q at position 107, E by H at position 107, K by Q at position 108, K by T at position 108, K by S at position 108, K by H at position 108, E by Q at position 109, E by H at position 109, D by Q at position 110, D by H at position 110, D by G at position 110, F by I at position 111, F by V at position 111, R by H at position 113, R by Q at position 113, L by V at position 116, L by I at position 116, L by T at position 116, L by Q at position 116, L by H at position 116, L by A at position 116, L by V at position 120, L by I at position 120, L by T at position 120, L by Q at position 120, L by H at position 120, L by A at position 120, K by Q at position 123, K by T at position 123, K by S at position 123, K by H at position 123, R by H at position 124, R by Q at position 124, R by H at position 128, R by Q at position 128, L by V at position 130, L by I at position 130, L by T at position 130, L by Q at position 130, L by H at position 130, L by A at position 130, K by Q at position 138, K by T at position 138, K by S at position 138, K by H at position 138, K by Q at position 136, K by T at position 136, K by S at position 136, K by H at position 136, E by Q at position 137, E by H at position 137, Y by H at position 163, Y by I at position 163, R by H at position 165, or R by Q at position 165, or any combination of such replacements, wherein the first amino acid listed is substituted by the second at the position indicated; where the variant further comprises an amino acid sequence that differs from the amino acid sequence of the parent polypeptide to the extent that the variant comprises one or more glycosylation sites not found in the parent polypeptide.

In particular embodiments, a hyperglycosylated, protease-resistant IFN-β variant (a "modified IFN-β cytokine") is selected from the group consisting of a modified IFN-β comprising an amino acid sequence as depicted in any of SEQ ID Nos.234-289, and 989-1302; where the variant further comprises an amino acid sequence that differs from the amino acid sequence of the parent polypeptide to the extent that the variant comprises one or more glycosylation sites not found in the parent polypeptide.

In particular embodiments, a hyperglycosylated, protease-resistant IFN-β variant (a "modified IFN-β cytokine") comprises one or more of the amino acid replacements set forth in Table 2 (IFN-β); where the variant further comprises an amino acid sequence that differs from the amino acid sequence of the parent polypeptide to the extent that the variant comprises one or more glycosylation sites not found in the parent polypeptide.

TABLE 2

| (IFN-β) | |
|---|---|
| 1. | D39Q |
| 2. | D39N |
| 3. | E42Q |
| 4. | E42N |
| 5. | E42H |
| 6. | K45Q |
| 7. | K45N |
| 8. | L47V |
| 9. | L47I |
| 10. | K52Q |
| 11. | K52N |
| 12. | F67I |
| 13. | F67V |
| 14. | R71H |
| 15. | R71Q |
| 16. | D73Q |
| 17. | D73N |
| 18. | E81Q |
| 19. | E81N |
| 20. | E81H |
| 21. | E107Q |
| 22. | E107N |
| 23. | E107H |
| 24. | K108Q |
| 25. | K108N |
| 26. | E109Q |
| 27. | E109N |
| 28. | E109H |
| 29. | D110Q |
| 30. | D110N |
| 31. | F111I |
| 32. | F111V |
| 33. | R113H |
| 34. | R113Q |

TABLE 2-continued (IFN-β)

| | |
|---|---|
| 35. | L116V |
| 36. | L116I |
| 37. | L120V |
| 38. | L120I |
| 39. | K123Q |
| 40. | K123N |
| 41. | R124H |
| 42. | R124Q |
| 43. | R128H |
| 44. | R128Q |
| 45. | L130V |
| 46. | L130I |
| 47. | K134Q |
| 48. | K134N |
| 49. | K136Q |
| 50. | K136N |
| 51. | E137Q |
| 52. | E137N |
| 53. | E137H |
| 54. | Y163H |
| 55. | Y163I |
| 56. | R165H |
| 57. | R165Q |

In some embodiments, any of the above-described hyperglycosylated or protease-resistant, hyperglycosylated IFN-β variants is a variant of IFN-β1a, and the variant is an [S102N] IFN-β1a glycopeptide, where the [S102N]IFN-β1a glycopeptide is a variant of IFN-β1a having (a) an asparagine residue substituted for the native serine residue at amino acid position 102 in the amino acid sequence of IFN-β1a (where the S102 amino acid position is as set forth in FIG. 24; and corresponds to S74 in the IFN-β amino acid sequence set forth in FIG. 3); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1a, and the variant is an [S102N, E138N]IFN-β1a glycopeptide, where the [S102N, E138N] IFN-β1a glycopeptide is a variant of IFN-β1a having (a) an asparagine residue substituted for each of the native serine and glutamic acid residues at amino acid positions 102 and 138, respectively, in the amino acid sequence of IFN-β1a (where the S102 and E 138 amino acid positions are as set forth in FIG. 24; and correspond to S74 and E109, respectively, in the IFN-β amino acid sequence set forth in FIG. 3); and (b) a carbohydrate moiety covalently attached to the R-group of each of said asparagine residues.

In some embodiments, any of the above-described hyperglycosylated or protease-resistant, hyperglycosylated IFN-β variants is a variant of IFN-β1a, and the variant is an [S102N, E138N, F136T]IFN-β1a glycopeptide, where the [S102N, E138N, F136T]IFN-β1a glycopeptide is a variant of IFN-β1a having (a) asparagine, asparagine and threonine residues substituted for the native serine, glutamic acid and phenylalanine residues at amino acid positions 102, 138 and 136, respectively, in the amino acid sequence of IFN-β1a (where the S102, E138, and F136 amino acid positions are as set forth in FIG. 24; and correspond to S74, E109, and F111, respectively, in the IFN-β amino acid sequence set forth in FIG. 3); and (b) a carbohydrate moiety covalently attached to the R-group of each of said asparagine residues.

In some embodiments, any of the above-described hyperglycosylated or protease-resistant, hyperglycosylated IFN-β variants is a variant of IFN-β1a, and the variant is an [E138N] IFN-β1a glycopeptide, where the [E138N]IFN-α1a glycopeptide is a variant of IFN-β1a having (a) an asparagine residue substituted for the native glutamic acid residue at amino acid position 138 in the amino acid sequence of IFN-β1a (where the amino acid positions are as set forth in FIG. 24); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1a, and the variant is an [E138N, F136T]IFN-β1a glycopeptide, where the [E138N, F136T] IFN-β1a glycopeptide is a variant of IFN-β1a having (a) asparagine and threonine residues substituted for the native glutamic acid and phenylalanine residues at amino acid positions 138 and 136, respectively, in the amino acid sequence of IFN-β 1a (where the amino acid positions are as set forth in FIG. 24); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1a, and the variant is an [E138T] IFN-β1a glycopeptide, where the [E138T]IFN-β1a glycopeptide is a variant of IFN-β1a having (a) a threonine residue substituted for the native glutamic acid residue at amino acid position 138 in the amino acid sequence of IFN-β1 a (where the amino acid positions are as set forth in FIG. 24); and (b) a carbohydrate moiety covalently attached to the R-group of said threonine residue.

In some embodiments, any of the above-described hyperglycosylated or protease-resistant, hyperglycosylated IFN-β variants is a variant of IFN-β1a, and the variant is an [S102N, E138T]IFN-β1a glycopeptide, where the [S102N, E138T] IFN-β1a glycopeptide is a variant of IFN-β1a having (a) asparagine and threonine residues substituted for the native serine and glutamic acid residues at amino acid positions 102 and 138, respectively, in the amino acid sequence of IFN-β1a (where the amino acid positions are as set forth in FIG. 24); and (b) a carbohydrate moiety covalently attached to the R-group of each of said asparagine and threonine residues.

In some embodiments, any of the above-described hyperglycosylated or protease-resistant, hyperglycosylated IFN-β variants is a variant of IFN-β1b, and the variant is an [S102N] IFN-β1b glycopeptide, where the [S102N]IFN-β1b glycopeptide is a variant of IFN-β1b having (a) an asparagine residue substituted for the native serine residue at amino acid position 102 in the amino acid sequence of IFN-β1b (where the amino acid positions are as set forth in FIG. 24); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1b, and the variant is an [S102N, E138N]IFN-β1b glycopeptide, where the [S102N, E138N] IFN-β1b glycopeptide is a variant of IFN-β1b having (a) an asparagine residue substituted for the native serine residue and glutamic acid residue at amino acid positions 102 and 138, respectively, in the amino acid sequence of IFN-β1b (where the amino acid positions are as set forth in FIG. 24); and (b) a carbohydrate moiety covalently attached to the R-group of each of said asparagine residues.

In some embodiments, any of the above-described hyperglycosylated or protease-resistant, hyperglycosylated IFN-β variants is a variant of IFN-β1b, and the variant is an [S102N, E138N, F136T]IFN-β1b glycopeptide, where the [S102N, E138N, F136T]IFN-β1b glycopeptide is a variant of IFN-β1b having (a) asparagine, asparagine and threonine residues substituted for the native serine, glutamic acid and phenylalanine residues at amino acid positions 102, 138 and 136, respectively, in the amino acid sequence of IFN-β1b (where the amino acid positions are as set forth in FIG. 24); and (b) a carbohydrate moiety covalently attached to the R-group of each of said asparagine residues.

In some embodiments, any of the above-described hyperglycosylated or protease-resistant, hyperglycosylated IFN-β variants is a variant of IFN-β1b, and the variant is an [E138N] IFN-β1b glycopeptide, where the [E138N]IFN-β1b glycopeptide is a variant of IFN-β1b having (a) an asparagine residue substituted for the native glutamic acid residue at amino acid position 138 in the amino acid sequence of IFN-β1b (where the amino acid positions are as set forth in FIG. 24); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1b, and the variant is an [E138N, F136T]IFN-β1b glycopeptide, where the [E138N, F136T] IFN-β1b glycopeptide is a variant of IFN-β1b having (a) asparagine and threonine residues substituted for the native glutamic acid and phenylalanine residues at amino acid positions 138 and 136, respectively, in the amino acid sequence of IFN-β1b (where the amino acid positions are as set forth in FIG. 24); and (b) a carbohydrate moiety covalently attached to the R-group of said asparagine residue.

In some embodiments, any of the above-described hyperglycosylated or protease-resistant, hyperglycosylated IFN-β variants is a variant of IFN-β1b, and the variant is an [E138T] IFN-β1b glycopeptide, where the [E138T]IFN-β1b glycopeptide is a variant of IFN-β1b having (a) a threonine residue substituted for the native glutamic acid residue at amino acid position 138 in the amino acid sequence of IFN-β1b (where the amino acid positions are as set forth in FIG. 24); and (b) a carbohydrate moiety covalently attached to the R-group of said threonine residue.

In some embodiments, any of the above-described hyperglycosylated or protease-resistant, hyperglycosylated IFN-β variants is a variant of IFN-β1b, and the variant is an [S102N, E138T]IFN-β1b glycopeptide, where the [S102N, E138T] IFN-β1b glycopeptide is a variant of IFN-β1b having (a) asparagine and threonine residues substituted for the native serine and glutamic acid residues at amino acid positions 102 and 138, respectively, in the amino acid sequence of IFN-β1b (where the amino acid positions are as set forth in FIG. 24); and (b) a carbohydrate moiety covalently attached to the R-group of each of said asparagine and threonine residues.

IFN-γ Polypeptide Variants

In other embodiments, the hyperglycosylated, protease-resistant interferon variant is a modified IFN-γ cytokine, comprising one or more amino acid replacements at one or more target positions in SEQ ID NO:1102 (as set forth in FIG. 4) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified IFN-γ. In some of these embodiments, the modified IFN-γ is selected from among proteins comprising one or more single amino acid replacements at one or more target positions in SEQ ID NO: 1102 (as set forth in FIG. 4), corresponding to any of amino acid positions: 33, 37, 40, 41, 42, 58, 61, 64, 65 and 66, where the mutations include insertions, deletions and replacements of the native amino acid residue(s). In particular embodiments, the replacements are selected from among amino acid substitutions in SEQ ID NO:1102 set forth in Table 3, below, where the first amino acid listed is substituted by the second amino acid at the position indicated; and where the variant further comprises an amino acid sequence that differs from the amino acid sequence of the parent polypeptide to the extent that the variant comprises one or more glycosylation sites not found in the parent polypeptide.

TABLE 3

| | |
|---|---|
| 1. | L33V |
| 2. | L33I |
| 3. | K37Q |
| 4. | K37N |
| 5. | K40Q |
| 6. | K40N |
| 7. | E41Q |
| 8. | E41N |
| 9. | E41H |
| 10. | E42Q |
| 11. | E42N |
| 12. | E42H |
| 13. | K58Q |
| 14. | K58N |
| 15. | K61Q |
| 16. | K61N |
| 17. | K64Q |
| 18. | K64N |
| 19. | D65Q |
| 20. | D65N |
| 21. | D66Q |

In other embodiments, the modified IFN-γ comprises an amino acid sequence corresponding to any of SEQ ID NOS: 290-311, and further comprises one or more glycosylation sites not found in the parent polypeptide.

In some embodiments, any of the above-described protease-resistant or protease-resistant, hyperglycosylated IFN-γ variants is an [S102T]IFN-gamma glycopeptide, where the [S102T]IFN-gamma glycopeptide is a variant of the mature, native IFN-gamma having (a) a threonine residue substituted for the native serine residue at amino acid position 102 in the amino acid sequence of IFN-gamma depicted in FIG. 31 (corresponding to S102 of the IFN-γ amino acid sequence set forth in FIG. 4); and (b) a carbohydrate moiety covalently attached to the R-group of the asparagine residue at amino acid position 97 in the amino acid sequence of (a); and comprising at least one mutated protease cleavage site in place of a native protease cleavage site found in the parent IFN-γ polypeptide.

Since the glycosylation site formed by N97, Y98, T102 in the [S102T]IFN-gamma variant is different than the glycosylation site formed by N97, Y98, S102 in native IFN-gamma, the N97, Y98, T102 glycosylation site qualifies as a non-native glycosylation site not found in the parent polypeptide. In addition, as described in WO 02/081507, the S1102T substitution in the amino acid sequence of native IFN-gamma provides for greater efficiency of glycosylation at the N97, Y98, T102 glycosylation site in the [S102T]IFN-gamma variant compared to the efficiency of glycosylation at the N97, Y98, S102 glycosylation site in native IFN-gamma. Thus, [S102T]IFN-gamma qualifies as a hyperglycosylated polypeptide variant of the parent IFN-gamma polypeptide (where the N97, Y98, and S102 amino acid positions in the IFN-γ amino acid sequence set forth in FIG. 31 correspond to N100, Y101, and S102 in the IFN-γ amino acid sequence set forth in FIG. 4).

In some embodiments, any of the above-described hyperglycosylated or protease-resistant, hyperglycosylated IFN-γ variants is an [E38N]IFN-gamma glycopeptide, where the [E38N]IFN-gamma glycopeptide is a variant of the mature, native IFN-gamma having (a) an asparagine residue substituted for the native glutamic acid residue at amino acid position 38 in the amino acid sequence of IFN-gamma depicted in FIG. 31 (where amino acid E38 in the IFN-γ amino acid sequence set forth in FIG. 31 corresponds to E41 of the IFN-γ amino acid sequence set forth in FIG. 4); and (b) a carbohydrate moiety covalently attached to the R-group of the asparagine residue at amino acid position 38 in the amino acid sequence of (a); and comprising at least one mutated protease cleavage site in place of a native protease cleavage site found in the parent IFN-γ polypeptide.

In some embodiments, any of the above-described hyperglycosylated or protease-resistant, hyperglycosylated IFN-γ variants is an [E38N, S102T]IFN-gamma glycopeptide, where the [E38N, S102T]IFN-gamma glycopeptide is a variant of the mature, native IFN-gamma having (a) asparagine and threonine residues substituted for the native glutamic acid and serine residues at amino acid positions 38 and 102 in the amino acid sequence of IFN-gamma depicted in FIG. 31 (where amino acids E38 and S102 in the IFN-γ amino acid sequence set forth in FIG. 31 correspond to E41 and S102, respectively, of the IFN-γ amino acid sequence set forth in FIG. 4); and (b) a carbohydrate moiety covalently attached to the R-group of the asparagine residue at each of amino acid positions 38 and 97 in the amino acid sequence of (a); and comprising at least one mutated protease cleavage site in place of a native protease cleavage site found in the parent IFN-γ polypeptide.

In some embodiments, any of the above-described hyperglycosylated or protease-resistant, hyperglycosylated IFN-γ variants is an [E38N, S40T]IFN-gamma glycopeptide, where the [E38N, S40T]IFN-gamma glycopeptide is a variant of the mature, native IFN-gamma having (a) asparagine and threonine residues substituted for the native glutamic acid and serine residues at amino acid positions 38 and 40 in the amino acid sequence of IFN-gamma depicted in FIG. 31 (where amino acids E38 and S40 in the IFN-γ amino acid sequence set forth in FIG. 31 correspond to E41 and S43, respectively, of the IFN-γ amino acid sequence set forth in FIG. 4); and (b) a carbohydrate moiety covalently attached to the R-group of the asparagine residue at amino acid position 38 in the amino acid sequence (a); and comprising at least one mutated protease cleavage site in place of a native protease cleavage site found in the parent IFN-γ polypeptide.

In some embodiments, any of the above-described hyperglycosylated or protease-resistant, hyperglycosylated IFN-γ variants is an [E38N, S40T, S102T]IFN-gamma glycopeptide, where the [E38N, S40T, S102T]IFN-gamma glycopeptide is a variant of the mature, native IFN-gamma having (a) asparagine, threonine and threonine residues substituted for the native glutamic acid, serine and serine residues at amino acid positions 38, 40 and 102, respectively, in the amino acid sequence of IFN-gamma depicted in FIG. 31 (where amino acids E38, S40, and S102 in the IFN-γ amino acid sequence set forth in FIG. 31 correspond to E41, S43, and S102, respectively, of the IFN-γ amino acid sequence set forth in FIG. 4); and (b) a carbohydrate moiety covalently attached to the R-group of the asparagine residue at amino acid position 38 in the amino acid sequence of (a), and optionally further having (c) a carbohydrate moiety covalently attached to the R-group of the asparagine residue at amino acid position 97 in the amino acid sequence of (a); and comprising at least one mutated protease cleavage site in place of a native protease cleavage site found in the parent IFN-γ polypeptide.

In some embodiments, any of the above-described hyperglycosylated, protease-resistant IFN-γ variants has increased stability compared to the unmodified (parent) cytokine, where the stability is assessed by measuring residual biological activity after incubation with either a mixture of proteases, individual proteases, blood lysate, or serum, as described above. In other embodiments, any of the above-described protease-resistant IFN-γ variants has increased biological activity compared to the unmodified (parent) cytokine, after incubation with either a mixture of proteases, individual proteases, blood lysate, or serum, as described above.

Erythropoietin Polypeptide Variants

In other embodiments, the hyperglycosylated, protease-resistant cytokine variant is a modified erythropoietin cytokine, comprising one or more amino acid replacements at one or more target positions in SEQ ID NO:201 (as set forth in FIG. 7) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified erythropoietin. In some of these embodiments, the modified erythropoietin is selected from among proteins comprising one or more single amino acid replacements at one or more target positions in SEQ ID NO: 201 (as set forth in FIG. 7), corresponding to any of amino acid positions: 43, 45, 48, 49, 52, 53, 55, 72, 75, 76, 123, 129, 130, 131, 162, and 165, where the mutations include insertions, deletions and replacements of the native amino acid residue(s). In particular embodiments, the replacements are selected from among amino acid substitutions in SEQ ID NO:201, set forth in Table 4, below, where the first amino acid listed is substituted by the second amino acid at the position indicated; and where the variant further comprises an amino acid sequence that differs from the amino acid sequence of the parent polypeptide to the extent that the variant comprises one or more glycosylation sites not found in the parent polypeptide.

TABLE 4

| | |
|---|---|
| 1. | D43Q |
| 2. | D43N |
| 3. | K45Q |
| 4. | K45N |
| 5. | F48I |
| 6. | F48V |
| 7. | Y49H |
| 8. | Y49I |
| 9. | K52Q |
| 10. | K52N |
| 11. | R53H |
| 12. | R53Q |
| 13. | E55Q |
| 14. | E55N |
| 15. | E55H |
| 16. | E72Q |
| 17. | E72N |
| 18. | E72H |
| 19. | L75V |
| 20. | L75I |
| 21. | R76H |
| 22. | R76Q |
| 23. | D123Q |
| 24. | D123N |
| 25. | P129S |
| 26. | P129A |
| 27. | L130V |
| 28. | L130I |
| 29. | R131H |
| 30. | R131Q |
| 31. | R162H |
| 32. | R162Q |
| 33. | D165Q |

TABLE 4-continued

| | |
|---|---|
| 34. | D165N |
| 35. | P121S |
| 36. | P121A |
| 37. | P122S |
| 38. | P122A |

In other embodiments, the modified erythropoietin comprises an amino acid sequence corresponding to any of SEQ ID NOS: 940-977, and further comprises one or more glycosylation sites not found in the parent polypeptide.

GM-CSF Polypeptide Variants

In other embodiments, hyperglycosylated, the protease-resistant cytokine variant is a modified GM-CSF cytokine, comprising one or more amino acid replacements at one or more target positions in SEQ ID NO:202 (as set forth in FIG. 8) corresponding to a structurally-related modified amino acid position within the 3-dimensional structure of an above-described erythropoietin polypeptide variant, where the replacement(s) lead to greater resistance to proteases, as assessed by incubation with a protease or with a blood lysate or by incubation with serum (as described above), compared to the unmodified GM-CSF. In some of these embodiments, the modified GM-CSF is selected from among proteins comprising one or more single amino acid replacements at one or more target positions in SEQ ID NO: 202 (as set forth in FIG. 8), corresponding to any of amino acid positions: 38, 41, 45, 46, 48, 49, 51, 60, 63, 67, 92, 93, 119, 120, 123, and 124, where the mutations include insertions, deletions and replacements of the native amino acid residue(s). In particular embodiments, the replacements are selected from among amino acid substitutions in SEQ ID NO:202, set forth in Table 5, below, where the first amino acid listed is substituted by the second amino acid at the position indicated; where the variant further comprises an amino acid sequence that differs from the amino acid sequence of the parent polypeptide to the extent that the variant comprises one or more glycosylation sites not found in the parent polypeptide.

TABLE 5

| | |
|---|---|
| 1. | E38Q |
| 2. | E38N |
| 3. | E38H |
| 4. | E41Q |
| 5. | E41N |
| 6. | E41H |
| 7. | E45Q |
| 8. | E45N |
| 9. | E45H |
| 10. | M46V |
| 11. | M46I |
| 12. | D48Q |
| 13. | D48N |
| 14. | L49V |
| 15. | L49I |
| 16. | E51Q |
| 17. | E51N |
| 18. | E51H |
| 19. | E60Q |
| 20. | E60N |
| 21. | E60H |
| 22. | K63Q |
| 23. | K63N |
| 24. | R67H |
| 25. | R67Q |
| 26. | P92S |
| 27. | P92A |
| 28. | E93Q |
| 29. | E93N |

TABLE 5-continued

| | |
|---|---|
| 30. | E93H |
| 31. | F119I |
| 32. | F119V |
| 33. | D120Q |
| 34. | D120N |
| 35. | E123Q |
| 36. | E123N |
| 37. | E123H |
| 38. | P124S |
| 39. | P124A |

In other embodiments, the modified GM-CSF comprises an amino acid sequence corresponding to any of SEQ ID NOs: 362-400, and further comprises one or more glycosylation sites not found in the parent polypeptide.

G-CSF Polypeptide Variants

In other embodiments, the hyperglycosylated, protease-resistant cytokine variant is a modified G-CSF cytokine, comprising one or more amino acid replacements at one or more target positions in SEQ ID NO:210 (as set forth in FIG. 5) corresponding to a structurally-related modified amino acid position within the 3-dimensional structure of an above-described IFN-α2b polypeptide variant, where the replacement(s) lead to greater resistance to proteases, as assessed by incubation with a protease or with a blood lysate or by incubation with serum (as described above), compared to the unmodified G-CSF. In some of these embodiments, the modified G-CSF is selected from among proteins comprising one or more single amino acid replacements at one or more target positions in SEQ ID NO:210 (as set forth in FIG. 5), corresponding to any of amino acid positions: 61, 63, 68, 72, 86, 96, 100, 101, 131, 133, 135, 147, 169, 172, and 177, where the mutations include insertions, deletions and replacements of the native amino acid residue(s). In particular embodiments, the replacements are selected from among amino acid substitutions in SEQ ID NO:210, set forth in Table 6, below, where the first amino acid listed is substituted by the second amino acid at the position indicated; where the variant further comprises an amino acid sequence that differs from the amino acid sequence of the parent polypeptide to the extent that the variant comprises one or more glycosylation sites not found in the parent polypeptide.

TABLE 6

| | |
|---|---|
| 1. | W61S |
| 2. | W61H |
| 3. | P63S |
| 4. | P63A |
| 5. | P68S |
| 6. | P68A |
| 7. | L72V |
| 8. | L72I |
| 9. | F86I |
| 10. | F86V |
| 11. | E96Q |
| 12. | E96N |
| 13. | E96H |
| 14. | P100S |
| 15. | P100A |
| 16. | E101Q |
| 17. | E101N |
| 18. | E101H |
| 19. | P131S |
| 20. | P131A |
| 21. | L133V |
| 22. | L133I |
| 23. | P135S |
| 24. | P135A |

TABLE 6-continued

| | |
|---|---|
| 25. | F147I |
| 26. | F147V |
| 27. | R169H |
| 28. | R169Q |
| 29. | R172H |
| 30. | R172Q |
| 31. | P177S |
| 32. | P177A |

In other embodiments, the modified G-CSF comprises an amino acid sequence corresponding to any of SEQ ID NOs: 631-662, and further comprises one or more glycosylation sites not found in the parent polypeptide.

Human Growth Hormone Polypeptide Variants

In other embodiments, the hyperglycosylated, protease-resistant cytokine variant is a modified human growth hormone (hGH) cytokine, comprising one or more amino acid replacements at one or more target positions in SEQ ID NO: 1405 (as set forth in FIG. 6) corresponding to a structurally-related modified amino acid position within the 3-dimensional structure of an above-described G-CSF polypeptide variant, where the replacement(s) lead to greater resistance to proteases, as assessed by incubation with a protease or with a blood lysate or by incubation with serum (as described above), compared to the unmodified hGH. In some of these embodiments, the modified hGH is selected from among proteins comprising one or more single amino acid replacements at one or more target positions in SEQ ID NO: 1405 (as set forth in FIG. 6), corresponding to any of amino acid positions: 56, 59, 64, 65, 66, 88, 92, 94, 101, 129, 130, 133, 138, 140, 143, 145, 146, 147, 183, and 186, where the mutations include insertions, deletions and replacements of the native amino acid residue(s). In particular embodiments, the replacements are selected from among amino acid substitutions in SEQ ID NO:201, set forth in Table 7, below, where the first amino acid listed is substituted by the second amino acid at the position indicated; where the variant further comprises an amino acid sequence that differs from the amino acid sequence of the parent polypeptide to the extent that the variant comprises one or more glycosylation sites not found in the parent polypeptide.

TABLE 7

| | |
|---|---|
| 1. | E56Q |
| 2. | E56N |
| 3. | E56H |
| 4. | P59S |
| 5. | P59A |
| 6. | R64H |
| 7. | R64Q |
| 8. | E65Q |
| 9. | E65N |
| 10. | E65H |
| 11. | E66Q |
| 12. | E66N |
| 13. | E66H |
| 14. | E88Q |
| 15. | E88N |
| 16. | E88H |
| 17. | F92I |
| 18. | F92V |
| 19. | R94H |
| 20. | R94Q |
| 21. | L101V |
| 22. | L101I |
| 23. | E129Q |
| 24. | E129N |
| 25. | E129H |

TABLE 7-continued

| | |
|---|---|
| 26. | D130Q |
| 27. | D130N |
| 28. | P133S |
| 29. | P133A |
| 30. | R134H |
| 31. | R134Q |
| 32. | K140Q |
| 33. | K140N |
| 34. | Y143H |
| 35. | Y143I |
| 36. | K145Q |
| 37. | K145N |
| 38. | F146I |
| 39. | F146V |
| 40. | D147Q |
| 41. | D147N |
| 42. | R183H |
| 43. | R183Q |
| 44. | E186Q |
| 45. | E186N |
| 46. | E186H |

In other embodiments, the modified hGH comprises an amino acid sequence corresponding to any of SEQ ID NOs: 850-895, and further comprises one or more glycosylation sites not found in the parent polypeptide.

In other embodiments, the hyperglycosylated, protease-resistant cytokine variant is a modified cytokine that exhibits greater resistance to proteolysis, compared to a corresponding unmodified (parent) cytokine, where the modified cytokine comprises one or more amino acid replacements at one or more target positions on the cytokine corresponding to a structurally-related modified amino acid position within the 3-dimensional structure of an above-described IFN-β polypeptide variant. The amino acid replacement(s) lead to greater resistance to proteolysis, compared to the unmodified (parent) cytokine. Increased resistance to proteolysis is assessed by incubation with a protease or with a blood lysate or by incubation with serum (as described above), compared to the unmodified hGH.

Additional Modifications

Typically, a hyperglycosylated or protease-resistant, hyperglycosylated polypeptide variant will have an amino acid sequence that is substantially similar to the amino acid sequence of a parent polypeptide. For example, a hyperglycosylated, protease-resistant polypeptide variant can have an amino acid sequence that differs by at least one amino acid, and may differ by at least two but not more than about ten amino acids, compared to the amino acid sequence of a parent polypeptide. The sequence changes may be substitutions, insertions or deletions. Scanning mutations that systematically introduce alanine, or other residues, may be used to determine key amino acids. Specific amino acid substitutions of interest include conservative and non-conservative changes. Conservative amino acid substitutions typically include substitutions within the following groups: (glycine, alanine); (valine, isoleucine, leucine); (aspartic acid, glutamic acid); (asparagine, glutamine); (serine, threonine); (lysine, arginine); or (phenylalanine, tyrosine).

Additional modifications of interest that may or may not alter the primary amino acid sequence of a parent protein therapeutic include chemical derivatization of polypeptides, e.g., acetylation, or carboxylation; changes in amino acid sequence that make the protein susceptible to PEGylation; and the like. A hyperglycosylated, protease-resistant polypeptide variant may be modified with one or more polyethylene glycol moieties (PEGylated). In one embodiment, the invention contemplates the use of polypeptide variants with one or more non-naturally occurring pegylation sites that are engineered to provide PEG-derivatized polypeptides with reduced serum clearance. Also embraced are sequences that have phosphorylated amino acid residues, e.g., phosphotyrosine, phosphoserine, or phosphothreonine.

Also suitable for use in connection with the present invention are polypeptides that have been modified using ordinary chemical techniques so as to improve their resistance to proteolytic degradation, to optimize solubility properties, or to render them more suitable as a therapeutic agent. For examples, the backbone of the peptide may be cyclized to enhance stability (see, for example, Friedler et al. 2000, *J. Biol. Chem.* 275:23783-23789). Analogs may be used that include residues other than naturally occurring L-amino acids, e.g., D-amino acids or non-naturally occurring synthetic amino acids. The protein may be pegylated to enhance stability.

Modifications of interest that may or may not alter the primary amino acid sequence include chemical derivatization of polypeptides, e.g., acetylation, or carboxylation; changes in amino acid sequence that make the protein susceptible to PEGylation (addition of a polyethylene glycol moiety); and the like. In one embodiment, the invention contemplates the use of synthetic Type I interferon receptor agonist variants, hyperglycosylated, protease-resistant polypeptide variants that further include one or more non-naturally occurring pegylation sites that are engineered to provide PEG-derivatized polypeptides with reduced serum clearance. Thus, the invention includes PEGylated synthetic Type I interferon receptor polypeptide agonist. Also included are modifications of glycosylation, e.g., those made by modifying the glycosylation patterns of a polypeptide during its synthesis and processing or in further processing steps; e.g., by exposing the polypeptide to enzymes that affect glycosylation, such as mammalian glycosylating or deglycosylating enzymes. The invention contemplates the use of any PEGylated hyperglycosylated, PEGylated protease-resistant and PEGylated preotease-resistent hyperglycosylated polypeptide variants. Also embraced are sequences that have phosphorylated amino acid residues, e.g., phosphotyrosine, phosphoserine, or phosphothreonine.

Fusion Proteins

In some embodiments, a hyperglycosylated, protease-resistant polypeptide variant further comprises a heterologous polypeptide (e.g., a fusion partner) to form a fusion protein. Suitable fusion partners include peptides and polypeptides that confer enhanced stability in vivo (e.g., enhanced serum half-life); provide ease of purification, e.g., $(HiS)_n$, e.g., 6His, and the like; provide for secretion of the fusion protein from a cell; provide an epitope tag, e.g., GST, hemagglutinin (HA; e.g., CYPYDVPDYA; SEQ ID NO:1304), FLAG (e.g., DYKDDDDK; SEQ ID NO:1305), c-myc (e.g., CEQKLISEEDL; SEQ ID NO:1306), and the like; provide a detectable signal, e.g., an enzyme that generates a detectable product (e.g., β-galactosidase, luciferase), or a protein that is itself detectable, e.g., a green fluorescent protein, etc.; provides for multimerization, e.g., a multimerization domain such as an Fc portion of an immunoglobulin; and the like.

A fusion protein may comprise an amino acid sequence that provides for secretion of the fusion protein from the cell. Those skilled in the art are aware of such secretion signal sequences. Secretion signals that are suitable for use in bacteria include, but are not limited to, the secretion signal of Braun's lipoprotein of *E. coli, S. marcescens, E. amylosora, M. morganii*, and *P. mirabilis*, the TraT protein of *E. coli* and *Salmonella*; the penicillinase (PenP) protein of *B. licheniformis* and *B. cereus* and *S. aureus*; pullulanase proteins of *Klebsiella pneumoniae* and *Klebsiella aerogenese; E. coli* lipoproteins 1pp-28, Pal, Rp1A, Rp1B, OsmB, NIpB, and Orl17; chitobiase protein of *V. harseyi*; the β-1,4-endoglucanase protein of *Pseudomonas solanacearum*, the Pal and Pcp proteins of *H. influenzae*; the OprI protein of *P. aeruginosa*; the MalX and AmiA proteins of *S. pneumoniae*; the 34 kda antigen and TpmA protein of *Treponema pallidum*; the P37 protein of *Mycoplasma hyorhinis*; the neutral protease of *Bacillus amyloliquefaciens*; and the 17 kda antigen of *Rickettsia rickettsii*. Secretion signal sequences suitable for use in yeast are known in the art, and can be used. See, e.g., U.S. Pat. No. 5,712,113.

In some embodiments, a signal peptide from IFN-α14 is used. In other embodiments, a signal peptide from IFN-β is used. Examples of synthetic Type I interferon receptor polypeptide agonist comprising an IFN-α14 or an IFN-β signal peptide are provided in Example 2. Such signal peptides provide for secretion from a mammalian cell.

In some embodiments, a hyperglycosylated, protease-resistant polypeptide variant comprises a fusion partner and a protease cleavage site that is positioned between the fusion partner and the remainder of the polypeptide variant.

Proteolytic cleavage sites are known to those skilled in the art; a wide variety are known and have been described amply in the literature, including, e.g., *Handbook of Proteolytic Enzymes* (11028) A J Barrett, N D Rawlings, and J F Woessner, eds., Academic Press. Proteolytic cleavage sites include, but are not limited to, an enterokinase cleavage site: $(Asp)_4$Lys (SEQ ID NO:1307); a factor Xa cleavage site: Ile-Glu-Gly-Arg (SEQ ID NO:1308); a thrombin cleavage site, e.g., Leu-Val-Pro-Arg-Gly-Ser (SEQ ID NO:1309); a renin cleavage site, e.g., His-Pro-Phe-His-Leu-Val-Ile-His (SEQ ID NO:1310); a collagenase cleavage site, e.g., X-Gly-Pro (where X is any amino acid); a trypsin cleavage site, e.g., Arg-Lys; a viral protease cleavage site, such as a viral 2A or 3C protease cleavage site, including, but not limited to, a protease 2A cleavage site from a picomavirus (see, e.g., Sommergruber et al. (11024) *Virol.* 198:741-745), a Hepatitis A virus 3C cleavage site (see, e.g., Schultheiss et al. (11025) *J. Virol.* 69:1727-1733), human rhinovirus 2A protease cleavage site (see, e.g., Wang et al. (11027) *Biochem. Biophys. Res. Comm.* 235:562-566), and a picornavirus 3 protease cleavage site (see, e.g., Walker et al. (11024) *Biotechnol.* 12:601-605.

Preparation of a Hyperglycosylated, Protease-resistant Polypeptide Variant

A subject synthetic Type I interferon receptor polypeptide agonist is conveniently prepared using any known method, including chemical synthesis methods, production by standard recombinant techniques, and combinations thereof. For example, a subject synthetic Type I interferon receptor polypeptide agonist can be synthesized using an automated solid-phase tert-butyloxycarbonyl and benzyl protection strategy. A subject synthetic Type I interferon receptor polypeptide agonist can be synthesized by native chemical ligation, e.g., fragments of from about 15 to about 40 amino acids in length (e.g., fragments of from about 15 to about 20, from about 20 to about 25, from about 25 to about 30, from about 30 to about 35, or from about 35 to about 40 amino acids in length) can be synthesized using standard methods of chemical synthesis, and the fragments ligated, using a process as described in Dawson, et al. (11024) *Science* 266:776-779. The purity of synthesized polypeptides may be assessed by reverse-phase high performance liquid chromatography (HPLC) and isoelectric focusing. The primary structures of the ligands may be verified by Edman sequencing methods.

In many embodiments, an expression vector comprising a nucleotide sequence that encodes a subject synthetic Type I interferon receptor polypeptide agonist is prepared, using conventional methods, and is introduced into a host cell, particularly a eukaryotic cell that is capable of glycosylating proteins. The expression vector provides for production of the subject synthetic Type I interferon receptor polypeptide agonist in the host cell. Thus, the present invention provides a method for producing a synthetic Type I interferon receptor polypeptide agonist, the method comprising culturing a eukaryotic host cell, which host cell comprises a subject recombinant expression vector, under conditions that favor production of the synthetic Type I interferon receptor polypeptide agonist; and isolating the synthetic Type I interferon receptor polypeptide agonist from the culture. The subject polypeptide agonist may be isolated and purified to greater than 80%, greater than 90%, greater than 95%, greater than 98%, or greater than 102% purity.

The polypeptides may be expressed in prokaryotes or eukaryotes in accordance with conventional ways, depending upon the purpose for expression. As noted above, in many embodiments, a subject synthetic Type I interferon receptor polypeptide agonist is synthesized in a eukaryotic cell. For large scale production of the protein, a unicellular organism, such as *S. cerevisiae*, insect cells in combination with baculovirus vectors, or cells of a higher organism such as vertebrates, particularly mammals, e.g. COS 7 cells, CHO cells, HEK293 cells, and the like, may be used as the expression host cells. In many embodiments, it is desirable to express the gene in eukaryotic cells, where the protein will benefit from native folding and post-translational modifications.

With the availability of the protein or fragments thereof in large amounts, by employing an expression host, the protein may be isolated and purified in accordance with conventional ways. A lysate may be prepared of the expression host and the lysate purified using HPLC, hydrophobic interaction chromatography (HIC), anion exchange chromatography, cation exchange chromatography, size exclusion chromatography, ultrafiltration, gel electrophoresis, affinity chromatography, or other purification technique.

A subject synthetic Type I interferon receptor polypeptide agonist may also be isolated and purified from cell culture supernatants or from cell lysates using conventional methods. For example, a lysate may be prepared of the expression host and the lysate purified using HPLC, hydrophobic interaction chromatography (HIC), anion exchange chromatography, cation exchange chromatography, size exclusion chromatography, ultrafiltration, gel electrophoresis, affinity chromatography, or other purification technique. For the most part, the compositions which are used will comprise at least 20% by weight of the desired product, more usually at least about 75% by weight, preferably at least about 95% by weight, and for therapeutic purposes, usually at least about 102.5% by weight, in relation to contaminants related to the method of preparation of the product and its purification. Usually, the percentages will be based upon total protein.

In many embodiments, a subject synthetic Type I interferon receptor polypeptide agonist is purified, e.g., a subject synthetic Type I interferon receptor polypeptide agonist is free of other, non-subject proteins, and is free other macromolecules (e.g., carbohydrates, lipids, etc.). In many embodiments, a subject synthetic Type I interferon receptor polypeptide agonist is at least about 75% pure, at least about 80% pure, at least about 85% pure, at least about 90% pure, at least about 95% pure, at least about 98% pure, or at least about 102% pure, or more than 102% pure. Methods of determining whether a protein is free of other proteins and other macromolecules are known in the art.

The hyperglycosylated, protease-resistant polypeptide variants may be prepared by recombinant methods, using conventional techniques known in the art. The particular sequence and the manner of preparation will be determined by convenience, economics, purity required, and the like.

Typically, an oligonucleotide encoding the amino acid sequence of the desired polypeptide variant is prepared by chemical synthesis, e.g., by using an oligonucleotide synthesizer, wherein oligonucleotides are designed based on the amino acid sequence of the desired polypeptide, and in many embodiments, selecting those codons that are favored in the host cell in which the recombinant polypeptide will be produced. For example, several small oligonucleotides coding for portions of the desired polypeptide may be synthesized and assembled by PCR, ligation or ligation chain reaction (LCR). The individual oligonucleotides typically contain 5' or 3' overhangs for complementary assembly. Once assembled, the nucleotide sequence encoding the polypeptide variant is inserted into a recombinant vector and operably linked to control sequences necessary for expression of the desired nucleic acid, and subsequent production of the subject polypeptide, in the desired transformed host cell.

In some embodiments, a desired nucleic acid is generated such that at least about 10%, at least about 20%, at least about 30%, at least about 40%, at least about 50%, at least about 60%, at least about 70%, at least about 80%, or at least about 90%, or more, of the codons are codons that are preferred in human sequences. See, e.g., Table 8, below.

TABLE 8

Codon Usage in Human. Molecular Cloning: A Laboratory Manual. Sambrook J. and Russell D. W. Third Edition © 2001 by Cold Spring Harbor Press.

| AMINO ACID | FREQUENCY IN HUMAN PROTEINS (%)[a] | CODONS AND THEIR USAGE IN HUMAN PROTEINS (%)[b] | |
|---|---|---|---|
| Alanine | 6.99 | GCU (28.0) | GCC (41.6) |
| | | GCA (20.0) | GCG (10.3) |
| Arginine | 5.28 | CGU (8.9) | CGC (21.4) |
| | | CGA (5.4) | CGG (10.4) |
| | | AGA (9.9) | AGG (11.1) |
| Asparagine | 3.92 | AAU (42.3) | AAC (57.7) |
| Aspartic Acid | 5.07 | GAU (42.8) | GAC (57.2) |
| Cysteine | 2.44 | UGU (40.6) | UGC (59.4) |
| Glutamic Acid | 6.82 | GAA (39.2) | GAG (60.7) |
| Glutamine | 4.47 | CAA (24.8) | CAG (75.2) |
| Glycine | 7.10 | GGU (15.8) | GGC (35.8) |
| | | GGA (24.1) | GGG (24.3) |
| Histidine | 2.35 | CAU (39.6) | CAC (60.4) |
| Isoleucine | 4.50 | AUU (33.1) | AUC (54.0) |
| | | AUA (12.9) | |
| Leucine | 9.56 | UUA (5.5) | UUG (11.5) |
| | | CUU (11.1) | CUC (20.8) |
| | | CUA (6.5) | CUG (44.5) |
| Lysine | 5.71 | AAA (38.9) | AAG (61.1) |
| Methionine | 2.23 | AUG (100) | |
| Phenylalaine | 3.84 | UUU (41.1) | UUC (58.2) |
| Proline | 5.67 | CCU (27.3) | CCC (35.2) |
| | | CCA (25.7) | CCG (11.6) |
| Serine | 7.25 | UCU (18.3) | UCC (23.7) |
| | | UCA (12.9) | UCG (5.9) |
| | | AGU (13.2) | AGC (25.9) |
| Threonine | 5.68 | ACU (22.4) | ACC (40.5) |
| | | ACA (25.4) | ACG (11.8) |
| Tryptophan | 1.38 | UGG (100) | |
| Tyrosine | 3.13 | UAU (40.0) | UAC (60.0) |
| Valine | 6.35 | GUU (16.4) | GUC (25.7) |
| | | GUA (9.3) | GUG (48.7) |

The polypeptide-encoding nucleic acid molecules are generally propagated by placing the molecule in a vector. Viral and non-viral vectors are used, including plasmids. The choice of plasmid will depend on the type of cell in which propagation is desired and the purpose of propagation. Certain vectors are useful for amplifying and making large amounts of the desired DNA sequence.

A recombinant expression vector is useful for effecting expression of a polypeptide-encoding nucleic acid molecule in a cell, e.g., for production of a hyperglycosylated, protease-resistant polypeptide variant. The choice of appropriate vector is well within the skill of the art. Many such vectors are available commercially.

Expression vectors are suitable for expression in cells in culture. These vectors will generally include regulatory sequences ("control sequences" or "control regions") which are necessary to effect the expression of a desired polynucleotide to which they are operably linked.

Expression vectors generally have convenient restriction sites located near the promoter sequence to provide for the insertion of nucleic acid sequences encoding a desired protein or other protein. A selectable marker operative in the expression host may be present. Expression vectors may be used for the production of fusion proteins, where the exogenous fusion peptide provides additional functionality, i.e. increased protein synthesis, stability, reactivity with defined antisera, an enzyme marker, e.g. β-galactosidase, luciferase, etc.

Expression cassettes may be prepared that comprise a transcription initiation region, a promoter region (e.g., a promoter that is functional in a eukaryotic cell), a desired polynucleotide, and a transcriptional termination region. After introduction of the DNA, the cells containing the construct may be selected by means of a selectable marker, the cells expanded and then used for expression.

The expression cassettes may be introduced into a variety of vectors suitable for eukaryotic host cell expression, e.g. plasmid, HAC, YAC, vectors derived from animal viruses, e.g., Moloney's murine leukemia virus, SV40, vaccinia virus, baculovirus, retroviruses, or plant viruses, e.g., cauliflower mosaic virus, tobacco mosaic virus, and the like, where the vectors are normally characterized by the ability to provide selection of cells comprising the expression vectors. The vectors may provide for extrachromosomal maintenance, particularly as plasmids or viruses, or for integration into the host chromosome. Where extrachromosomal maintenance is desired, an origin sequence is provided for the replication of the plasmid, which may be low- or high copy-number. A wide variety of markers are available for selection, particularly those which protect against toxins, more particularly against antibiotics. The particular marker that is chosen is selected in accordance with the nature of the host, where in some cases, complementation may be employed with auxotrophic hosts. Introduction of the DNA construct into a host cell may use any convenient method, e.g., calcium-precipitated DNA, electroporation, fusion, transfection, infection with viral vectors, biolistics, etc.

The present invention further contemplates the production of hyperglycosylated, protease-resistant polypeptide variants in genetically modified host cells, which may be isolated host cells, comprising a polynucleotide encoding the polypeptide variant, or, in some embodiments, an expression vector capable of expressing such a polynucleotide. Suitable host cells are eukaryotic cells, including insect cells in combination with baculovirus vectors, yeast cells, such as *Saccharomyces cerevisiae*, or cells of a higher organism such as vertebrates, including amphibians (e.g., *Xenopus laevis* oocytes), and mammals, particularly mammals, e.g. COS cells, CHO cells, HEK293 cells, MA-10 cells, and the like, may be used as the expression host cells. In particular, the host cell is a eukaryotic host cell that is capable of glycosylating a protein.

The hyperglycosylated, protease-resistant polypeptide variant can be harvested from the production host cells and then isolated and purified in accordance with conventional methods of recombinant synthesis. A lysate may be prepared of the expression host and the lysate purified using high performance liquid chromatography, exclusion chromatography, gel electrophoresis, affinity chromatography, or other purification technique. For the most part, the compositions which are used will comprise at least 20% by weight of the desired product, more usually at least about 75% by weight, preferably at least about 95% by weight, and for therapeutic purposes, usually at least about 102.5% by weight, in relation to contaminants related to the method of preparation of the product and its purification. Usually, the percentages will be based upon total protein.

PEGylated Type I Interferon Receptor Polypeptide Agonists

As noted above, in some embodiments, a subject synthetic Type I interferon receptor polypeptide agonist is modified with one or more polyethylene glycol moieties, i.e., PEGylated. The PEG molecule is conjugated to one or more amino acid side chains of the subject polypeptide agonist. In some embodiments, a subject PEGylated polypeptide agonist contains a PEG moiety on only one amino acid. In other embodiments, a subject PEGylated polypeptide agonist contains a PEG moiety on two or more amino acids, e.g., the subject PEGylated polypeptide agonist contains a PEG moiety attached to two, three, four, five, six, seven, eight, nine, or ten different amino acid residues.

A subject polypeptide may be coupled directly to PEG (i.e., without a linking group) through an amino group, a sulfhydryl group, a hydroxyl group, or a carboxyl group.

In some embodiments, the PEGylated subject polypeptide is PEGylated at or near the amino terminus (N-terminus) of the subject polypeptide, e.g., the PEG moiety is conjugated to the subject polypeptide at one or more amino acid residues from amino acid 1 through amino acid 4, or from amino acid 5 through about 10. In other embodiments, the PEGylated subject polypeptide is PEGylated at one or more amino acid residues from about 10 to about 28. In other embodiments, the PEGylated subject polypeptide is PEGylated at or near the carboxyl terminus (C-terminus) of the subject polypeptide, e.g., at one or more residues from amino acids 156-166, or from amino acids 150 to 155. In other embodiments, the PEGylated subject polypeptide is PEGylated at one or more amino acid residues at one or more residues from amino acids 100-114.

The polyethylene glycol derivatization of amino acid residues at or near the receptor-binding and/or active site domains of the subject protein can disrupt the functioning of these domains. In certain embodiments of the invention, amino acids at which PEGylation is to be avoided include amino acid residues from amino acid 30 to amino acid 40; and amino acid residues from amino acid 113 to amino acid 149.

In some embodiments, PEG is attached to the subject polypeptide via a linking group. The linking group is any biocompatible linking group, where "biocompatible" indicates that the compound or group is non-toxic and may be utilized in vitro or in vivo without causing injury, sickness, disease, or death. PEG can be bonded to the linking group, for example, via an ether bond, an ester bond, a thiol bond or an amide bond. Suitable biocompatible linking groups include, but are not limited to, an ester group, an amide group, an imide group, a carbamate group, a carboxyl group, a hydroxyl group, a carbohydrate, a succinimide group (including, for example, succinimidyl succinate (SS), succinimidyl propionate (SPA), succinimidyl butanoate (SBA), succinimidyl carboxymethylate (SCM), succinimidyl succinamide (SSA) or N-hydroxy succinimide (NHS)), an epoxide group, an oxycarbonylimidazole group (including, for example, carbonyldimidazole (CDI)), a nitro phenyl group (including, for example, nitrophenyl carbonate (NPC) or trichlorophenyl carbonate (TPC)), a trysylate group, an aldehyde group, an isocyanate group, a vinylsulfone group, a tyrosine group, a cysteine group, a histidine group or a primary amine.

Methods for making succinimidyl propionate (SPA) and succinimidyl butanoate (SBA) ester-activated PEGs are described in U.S. Pat. No. 5,672,662 (Harris, et al.) and WO 97/03106.

Methods for attaching a PEG to a polypeptide are known in the art, and any known method can be used. See, for example, by Park et al, Anticancer Res., 1:373-376 (1981); Zaplipsky and Lee, Polyethylene Glycol Chemistry: Biotechnical and Biomedical Applications, J. M. Harris, ed., Plenum Press, NY, Chapter 21 (11022); U.S. Pat. No. 5,985,265; U.S. Pat. No. 5,672,662 (Harris, et al.) and WO 97/03106.

In many embodiments, the PEG is a monomethoxyPEG molecule that reacts with primary amine groups on the subject polypeptide. Methods of modifying polypeptides with monomethoxy PEG via reductive alkylation are known in the art. See, e.g., Chamow et al. (11024) Bioconj. Chem. 5:133-140.

Polyethylene Glycol

Polyethylene glycol suitable for conjugation to a subject polypeptide is soluble in water at room temperature, and has the general formula R(O—CH$_2$—CH$_2$)$_n$O—R, where R is hydrogen or a protective group such as an alkyl or an alkanol group, and where n is an integer from 1 to 1000. Where R is a protective group, it generally has from 1 to 8 carbons.

In many embodiments, PEG has at least one hydroxyl group, e.g., a terminal hydroxyl group, which hydroxyl group is modified to generate a functional group that is reactive with an amino group, e.g., an epsilon amino group of a lysine residue, a free amino group at the N-terminus of a polypeptide, or any other amino group such as an amino group of asparagine, glutamine, arginine, or histidine.

In other embodiments, PEG is derivatized so that it is reactive with free carboxyl groups in the subject polypeptide, e.g., the free carboxyl group at the carboxyl terminus of the subject polypeptide. Suitable derivatives of PEG that are reactive with the free carboxyl group at the carboxyl-terminus of a subject polypeptide include, but are not limited to PEG-amine, and hydrazine derivatives of PEG (e.g., PEG-NH—NH$_2$).

In other embodiments, PEG is derivatized such that it comprises a terminal thiocarboxylic acid group, —COSH, which selectively reacts with amino groups to generate amide derivatives. Because of the reactive nature of the thio acid, selectivity of certain amino groups over others is achieved. For example, —SH exhibits sufficient leaving group ability in reaction with N-terminal amino group at appropriate pH conditions such that the ε-amino groups in lysine residues are protonated and remain non-nucleophilic. On the other hand, reactions under suitable pH conditions may make some of the accessible lysine residues to react with selectivity.

In other embodiments, the PEG comprises a reactive ester such as an N-hydroxy succinimidate at the end of the PEG chain. Such an N-hydroxysuccinimidate-containing PEG molecule reacts with select amino groups at particular pH conditions such as neutral 6.5-7.5. For example, the N-terminal amino groups may be selectively modified under neutral pH conditions. However, if the reactivity of the reagent were extreme, accessible-NH$_2$ groups of lysine may also react.

The PEG can be conjugated directly to the subject polypeptide, or through a linker. In some embodiments, a linker is added to the subject polypeptide, forming a linker-modified polypeptide. Such linkers provide various functionalities, e.g., reactive groups such sulfhydryl, amino, or carboxyl groups to couple a PEG reagent to the linker-modified polypeptide.

In some embodiments, the PEG conjugated to the subject polypeptide is linear. In other embodiments, the PEG conjugated to the subject polypeptide is branched. Branched PEG derivatives such as those described in U.S. Pat. No. 5,643,575, "star-PEG's" and multi-armed PEG's such as those described in Shearwater Polymers, Inc. catalog "Polyethylene Glycol Derivatives 11027-11028." Star PEGs are described in the art including, e.g., in U.S. Pat. No. 6,046,305.

PEG having a molecular weight in a range of from about 2 kDa to about 100 kDa, is generally used, where the term "about," in the context of PEG, indicates that in preparations of polyethylene glycol, some molecules will weigh more, some less, than the stated molecular weight. For example, PEG suitable for conjugation to a subject polypeptide has a molecular weight of from about 2 kDa to about 5 kDa, from about 5 kDa to about 10 kDa, from about 10 kDa to about 15 kDa, from about 15 kDa to about 20 kDa, from about 20 kDa to about 25 kDa, from about 25 kDa to about 30 kDa, from about 30 kDa to about 40 kDa, from about 40 kDa to about 50 kDa, from about 50 kDa to about 60 kDa, from about 60 kDa to about 70 kDa, from about 70 kDa to about 80 kDa, from about 80 kDa to about 90 kDa, or from about 90 kDa to about 100 kDa.

Populations of Subject Synthetic Type I Interferon Receptor Polypeptide Agonists The instant invention provides a composition that comprises a population of synthetic Type I interferon receptor polypeptide agonists as described above. The subject composition comprises a population of subject polypeptides, wherein the population comprises at least two different subject synthetic Type I interferon receptor polypeptide agonists (e.g., polypeptide agonists that differ from one another in amino acid sequence by at least one amino acid).

Generally, a given subject synthetic Type I interferon receptor polypeptide agonist represents from about 0.5% to about 102.5% of the total population of synthetic Type I interferon receptor polypeptide agonists in a population, e.g., a given modified synthetic Type I interferon receptor polypeptide agonist represents about 0.5%, about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 102%, or about 102.5% of the total population of synthetic Type I interferon receptor polypeptide agonists in a population.

Compositions

The present invention provides compositions, including pharmaceutical compositions, comprising a subject synthetic Type I interferon receptor polypeptide agonist, a known hyperglycosylated polypeptide variant, a known protease-resistant polypeptide variant, or a known hyperglycosylated, protease-resistant polypeptide variant, i.e., a polypeptide variant of a parent protein therapeutic that comprises at least one mutated protease cleavage site in place of a native protease cleavage site found in the parent protein therapeutic; and that includes (1) a carbohydrate moiety covalently attached to at least one non-native glycosylation site not found in the parent protein therapeutic and/or (2) a carbohydrate moiety covalently attached to at least one native glycosylation site found but not glycosylated in the parent protein therapeutic. Compositions will comprise a subject synthetic Type I interferon receptor polypeptide agonist, a known hyperglycosylated polypeptide variant, a known protease-resistant polypeptide variant, or a known hyperglycosylated, protease-resistant polypeptide variant; and one or more additional components, which are selected based in part on the use of the polypeptide variant. Suitable additional components include, but are not limited to, salts, buffers, solubilizers, stabilizers, detergents, protease-inhibiting agents, and the like.

In some embodiments, a subject composition comprises a subject synthetic Type I interferon receptor polypeptide agonist, a known hyperglycosylated polypeptide variant or a known hyperglycosylated, protease-resistant polypeptide variant and a pharmaceutically acceptable excipient. A wide variety of pharmaceutically acceptable excipients are known in the art and need not be discussed in detail herein. Pharmaceutically acceptable excipients have been amply described in a variety of publications, including, for example, A. Gennaro (2000) "Remington: The Science and Practice of Pharmacy," 20$^{th}$ edition, Lippincott, Williams, & Wilkins; Pharmaceutical Dosage Forms and Drug Delivery Systems (11029) H. C. Ansel et al., eds., 7$^{th}$ ed., Lippincott, Williams, & Wilkins; and Handbook of Pharmaceutical Excipients (2000) A. H. Kibbe et al., eds., 3$^{rd}$ ed. Amer. Pharmaceutical Assoc.

In pharmaceutical dosage forms, a subject synthetic Type I interferon receptor polypeptide agonist, a known hyperglycosylated polypeptide variant or a known hyperglycosylated, protease-resistant polypeptide variant is in some embodiments provided in the form of a pharmaceutically acceptable salts, used alone, or in appropriate association, as well as in combination, with other pharmaceutically active compounds.

Formulations Suitable for Injection

A subject synthetic Type I interferon receptor polypeptide agonist is in some embodiments formulated into a preparation suitable for injection (e.g., subcutaneous, intravenous, intramuscular, intradermal, transdermal, or other injection routes) by dissolving, suspending or emulsifying the agonist in an aqueous solvent (e.g., saline, and the like) or a nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

Formulations for Enteral Delivery

For oral preparations, a subject agent (e.g., a subject synthetic Type I interferon receptor polypeptide agonist) is formulated alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives, and flavoring agents.

Furthermore, a subject agonist can be made into suppositories by mixing with a variety of bases such as emulsifying bases or water-soluble bases. A subject agonist can be administered rectally via a suppository. The suppository can include vehicles such as cocoa butter, carbowaxes and polyethylene glycols, which melt at body temperature, yet are solidified at room temperature.

Unit dosage forms for oral or rectal administration such as syrups, elixirs, and suspensions may be provided wherein each dosage unit, for example, teaspoonful, tablespoonful, tablet or suppository, contains a predetermined amount of the composition containing one or more active agents. Similarly, unit dosage forms for injection or intravenous administration may comprise the agonist(s) in a composition as a solution in sterile water, normal saline or another pharmaceutically acceptable carrier.

For enteral delivery, a subject formulation will in some embodiments include an enteric-soluble coating material. Suitable enteric-soluble coating material include hydroxypropyl methylcellulose acetate succinate (HPMCAS), hydroxypropyl methyl cellulose phthalate (HPMCP), cellulose acetate phthalate (CAP), polyvinyl phthalic acetate (PVPA), Eudragit™, and shellac.

As one non-limiting example of a suitable oral formulation, a subject synthetic Type I interferon receptor polypeptide agonist can be formulated together with one or more pharmaceutical excipients and coated with an enteric coating, as described in U.S. Pat. No. 6,346,269. For example, a solution comprising a solvent, a subject synthetic Type I interferon receptor polypeptide agonist, and a stabilizer is coated onto a core comprising pharmaceutically acceptable excipients, to form an active agent-coated core; a sub-coating layer is applied to the active agent-coated core, which is then coated with an enteric coating layer. The core generally includes pharmaceutically inactive components such as lactose, a starch, mannitol, sodium carboxymethyl cellulose, sodium starch glycolate, sodium chloride, potassium chloride, pigments, salts of alginic acid, talc, titanium dioxide, stearic acid, stearate, micro-crystalline cellulose, glycerin, polyethylene glycol, triethyl citrate, tributyl citrate, propanyl triacetate, dibasic calcium phosphate, tribasic sodium phosphate, calcium sulfate, cyclodextrin, and castor oil. Suitable solvents for the active agent include aqueous solvents. Suitable stabilizers include alkali-metals and alkaline earth metals, bases of phosphates and organic acid salts and organic amines. The sub-coating layer comprises one or more of an adhesive, a plasticizer, and an anti-tackiness agent. Suitable anti-tackiness agents include talc, stearic acid, stearate, sodium stearyl fumarate, glyceryl behenate, kaolin and aerosil. Suitable adhesives include polyvinyl pyrrolidone (PVP), gelatin, hydroxyethyl cellulose (HEC), hydroxypropyl cellulose (HPC), hydroxypropyl methyl cellulose (HPMC), vinyl acetate (VA), polyvinyl alcohol (PVA), methyl cellulose (MC), ethyl cellulose (EC), hydroxypropyl methyl cellulose phthalate (HPMCP), cellulose acetate phthalates (CAP), xanthan gum, alginic acid, salts of alginic acid, Eudragit™, copolymer of methyl acrylic acid/methyl methacrylate with polyvinyl acetate phthalate (PVAP). Suitable plasticizers include glycerin, polyethylene glycol, triethyl citrate, tributyl citrate, propanyl triacetate and castor oil. Suitable enteric-soluble coating material include hydroxypropyl methylcellulose acetate succinate (HPMCAS), hydroxypropyl methyl cellulose phthalate(HPMCP), cellulose acetate phthalate (CAP), polyvinyl phthalic acetate (PVPA), Eudragit™ and shellac.

Suitable oral formulations also include a subject synthetic Type I interferon receptor polypeptide agonist formulated with any of the following: microgranules (see, e.g., U.S. Pat. No. 6,458,398); biodegradable macromers (see, e.g., U.S.

Pat. No. 6,703,037); biodegradable hydrogels (see, e.g., Graham and McNeill (1989) *Biomaterials* 5:27-36); biodegradable particulate vectors (see, e.g., U.S. Pat. No. 5,736,371); bioabsorbable lactone polymers (see, e.g., U.S. Pat. No. 5,631,015); slow release protein polymers (see, e.g., U.S. Pat. No. 6,6102,504; Pelias Technologies, Inc.); a poly(lactide-co-glycolide/polyethylene glycol block copolymer (see, e.g., U.S. Pat. No. 6,630,155; Atrix Laboratories, Inc.); a composition comprising a biocompatible polymer and particles of metal cation-stabilized agent dispersed within the polymer (see, e.g., U.S. Pat. No. 6,379,701; Alkermes Controlled Therapeutics, Inc.); and microspheres (see, e.g., U.S. Pat. No. 6,303,148; Octoplus, B. V.).

Suitable oral formulations also include a subject synthetic Type I interferon receptor polypeptide agonist formulated with any of the following: a carrier such as Emisphere® (Emisphere Technologies, Inc.); TIMERx, a hydrophilic matrix combining xanthan and locust bean gums which, in the presence of dextrose, form a strong binder gel in water (Penwest); Geminex™ (Penwest); Procise™ (GlaxoSmithKline); SAVIT™ (Mistral Pharma Inc.); RingCap™ (Alza Corp.); Smartrix® (Smartrix Technologies, Inc.); SQZgel™ (MacroMed, Inc.); Geomatrix™ (Skye Pharma, Inc.); Oros® Trilayer (Alza Corporation); and the like.

Also suitable for use are formulations such as those described in U.S. Pat. No. 6,296,842 (Alkermes Controlled Therapeutics, Inc.); U.S. Pat. No. 6,187,330 (Scios, Inc.); and the like.

Formulations for Oral Delivery

The present invention provides pharmaceutical compositions comprising a subject synthetic Type I interferon receptor polypeptide agonist, a known hyperglycosylated polypeptide variant, a known protease-resistant polypeptide variant, or a known hyperglycosylated, protease-resistant polypeptide variant; and a pharmaceutical excipient suitable for oral delivery.

For oral preparations, a subject synthetic Type I interferon receptor polypeptide agonist, a known hyperglycosylated polypeptide variant, a known protease-resistant polypeptide variant, or a known hyperglycosylated, protease-resistant polypeptide variant is formulated alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives, and flavoring agents.

Unit dosage forms for oral administration such as syrups, elixirs, and suspensions may be provided wherein each dosage unit, for example, teaspoonful, tablespoonful, tablet, contains a predetermined amount of the composition containing one or more active agents.

For oral delivery, a subject formulation will in some embodiments include an enteric-soluble coating material. Suitable enteric-soluble coating material include hydroxypropyl methylcellulose acetate succinate (HPMCAS), hydroxypropyl methyl cellulose phthalate (HPMCP), cellulose acetate phthalate (CAP), polyvinyl phthalic acetate (PVPA), Eudragit™ and shellac.

As one non-limiting example of a suitable oral formulation, a subject synthetic Type I interferon receptor polypeptide agonist, a known hyperglycosylated polypeptide variant, or a known hyperglycosylated, protease-resistant polypeptide variant can be formulated together with one or more pharmaceutical excipients and coated with an enteric coating, as described in U.S. Pat. No. 6,346,269. For example, a solution comprising a solvent, a known hyperglycosylated, protease-resistant polypeptide variant, and a stabilizer is coated onto a core comprising pharmaceutically acceptable excipients, to form an active agent-coated core; a sub-coating layer is applied to the active agent-coated core, which is then coated with an enteric coating layer. The core generally includes pharmaceutically inactive components such as lactose, a starch, mannitol, sodium carboxymethyl cellulose, sodium starch glycolate, sodium chloride, potassium chloride, pigments, salts of alginic acid, talc, titanium dioxide, stearic acid, stearate, micro-crystalline cellulose, glycerin, polyethylene glycol, triethyl citrate, tributyl citrate, propanyl triacetate, dibasic calcium phosphate, tribasic sodium phosphate, calcium sulfate, cyclodextrin, and castor oil. Suitable solvents for the active agent include aqueous solvents. Suitable stabilizers include alkali-metals and alkaline earth metals, bases of phosphates and organic acid salts and organic amines. The sub-coating layer comprises one or more of an adhesive, a plasticizer, and an anti-tackiness agent. Suitable anti-tackiness agents include talc, stearic acid, stearate, sodium stearyl fumarate, glyceryl behenate, kaolin and aerosil. Suitable adhesives include polyvinyl pyrrolidone (PVP), gelatin, hydroxyethyl cellulose (HEC), hydroxypropyl cellulose (HPC), hydroxypropyl methyl cellulose (HPMC), vinyl acetate (VA), polyvinyl alcohol (PVA), methyl cellulose (MC), ethyl cellulose (EC), hydroxypropyl methyl cellulose phthalate (HPMCP), cellulose acetate phthalates (CAP), xanthan gum, alginic acid, salts of alginic acid, Eudragit™, copolymer of methyl acrylic acid/methyl methacrylate with polyvinyl acetate phthalate (PVAP). Suitable plasticizers include glycerin, polyethylene glycol, triethyl citrate, tributyl citrate, propanyl triacetate and castor oil. Suitable enteric-soluble coating material include hydroxypropyl methylcellulose acetate succinate (HPMCAS), hydroxypropyl methyl cellulose phthalate(HPMCP), cellulose acetate phthalate (CAP), polyvinyl phthalic acetate (PVPA), Eudragit™ and shellac.

Suitable oral formulations also include a subject synthetic Type I interferon receptor polypeptide agonist, a known hyperglycosylated polypeptide variant or a known hyperglycosylated, protease-resistant polypeptide variant formulated with any of the following: microgranules (see, e.g., U.S. Pat. No. 6,458,398); biodegradable macromers (see, e.g., U.S. Pat. No. 6,703,037); biodegradable hydrogels (see, e.g., Graham and McNeill (1989) *Biomaterials* 5:27-36); biodegradable particulate vectors (see, e.g., U.S. Pat. No. 5,736,371); bioabsorbable lactone polymers (see, e.g., U.S. Pat. No. 5,631,015); slow release protein polymers (see, e.g., U.S. Pat. No. 6,6102,504; Pelias Technologies, Inc.); a poly(lactide-co-glycolide/polyethylene glycol block copolymer (see, e.g., U.S. Pat. No. 6,630,155; Atrix Laboratories, Inc.); a composition comprising a biocompatible polymer and particles of metal cation-stabilized agent dispersed within the polymer (see, e.g., U.S. Pat. No. 6,379,701; Alkermes Controlled Therapeutics, Inc.); and microspheres (see, e.g., U.S. Pat. No. 6,303,148; Octoplus, B. V.).

Suitable oral formulations also include a subject synthetic Type I interferon receptor polypeptide agonist, a known hyperglycosylated polypeptide variant or a known hyperglycosylated, protease-resistant polypeptide variant formulated with any of the following: a carrier such as Emisphere® (Emisphere Technologies, Inc.); TIMERx, a hydrophilic matrix combining xanthan and locust bean gums which, in the presence of dextrose, form a strong binder gel in water (Penwest); Geminex™ (Penwest); Procise™ (GlaxoSmithKline); SAVIT™ (Mistral Pharma Inc.); RingCap™ (Alza Corp.); Smartrix® (Smartrix Technologies, Inc.); SQZgel™ (MacroMed, Inc.); Geomatrix™ (Skye Pharma, Inc.); Oros® Trilayer (Alza Corporation); and the like.

Also suitable for use are formulations such as those described in U.S. Pat. No. 6,296,842 (Alkermes Controlled Therapeutics, Inc.); U.S. Pat. No. 6,187,330 (Scios, Inc.); and the like.

Also suitable for use herein are formulations comprising an intestinal absorption enhancing agent. Suitable intestinal absorption enhancers include, but are not limited to, calcium chelators (e.g., citrate, ethylenediamine tetracetic acid); surfactants (e.g., sodium dodecyl sulfate, bile salts, palmitoylcarnitine, and sodium salts of fatty acids); toxins (e.g., zonula occludens toxin); and the like.

In one aspect, a subject synthetic Type I interferon receptor polypeptide agonist, a known hyperglycosylated polypeptide variant or a known hyperglycosylated, protease-resistant polypeptide variant is in a first unit form of an orally delivered formulation. The known synthetic Type I interferon receptor polypeptide agonist, hyperglycosylated polypeptide variant or hyperglycosylated, protease-resistant polypeptide variant is a variant of a parent protein therapeutic. In these embodiments, the first unit form comprises a first number of moles of the known synthetic Type I interferon receptor polypeptide agonist, hyperglycosylated polypeptide variant or hyperglycosylated, protease-resistant polypeptide variant. The parent protein therapeutic is one that is typically administered at a dosage of a second number of moles of the parent protein therapeutic in a second unit form, where the second unit form is an immediate release formulation, e.g., an immediate release formulation that is suitable for subcutaneous injection. The parent protein therapeutic is delivered by subcutaneous bolus injection at a selected dosing frequency. The parent protein therapeutic must be proven to be effective in the treatment of a disease in a patient when administered to the patient in the second unit form by subcutaneous bolus injection at the selected dosing frequency. The first number of moles in the first unit form is greater than the second number of moles in the second unit form. Nevertheless, when the first unit form is administered orally to the patient, the first number of moles of the known hyperglycosylated, protease-resistant polypeptide variant is released by the first unit form over a period of time that is no greater than the time interval between doses of the parent protein therapeutic in the selected dosing frequency.

In another aspect, the oral pharmaceutical composition of the invention comprises a first dose of the known synthetic Type I interferon receptor polypeptide agonist, hyperglycosylated polypeptide variant, or hyperglycosylated, protease-resistant polypeptide variant in a first unit form. In these embodiments, the parent protein therapeutic is one that is typically administered at a second dose of the parent protein in a parenteral pharmaceutical composition, where the parenteral pharmaceutical composition is an immediate release formulation, e.g., an immediate release formulation suitable for bolus injection of the second dose at a selected dosing frequency. The parent protein therapeutic must be proven to be effective in the treatment of the disease in a patient when administered to the patient by subcutaneous bolus injection in an amount of the parenteral pharmaceutical composition whereby the patient receives the second dose of the parent protein therapeutic at the selected dosing frequency. When the first dose of the known synthetic Type I interferon receptor polypeptide agonist, hyperglycosylated polypeptide variant, or hyperglycosylated, protease-resistant polypeptide variant is administered orally to the patient, the time required for release of all of the known synthetic Type I interferon receptor polypeptide agonist, hyperglycosylated polypeptide variant, or hyperglycosylated, protease-resistant polypeptide variant in the first dose is no greater than the time between doses in the selected dosing interval. The amount of the known synthetic Type I interferon receptor polypeptide agonist, hyperglycosylated polypeptide variant, or hyperglycosylated, protease-resistant polypeptide variant in moles of drug per kilogram of patient body weight in the first dose is greater than the amount of parent protein therapeutic in moles of drug per kilogram of patient body weight in the second dose when the first and second doses are calculated for the average patient body weight in the total population of patients suffering from the disease.

In some embodiments, the second dose is a weight-based dose, and the first dose is greater in moles of drug than the product of the second dose in moles of drug per kilogram of patient body weight multiplied by an average patient's body weight (e.g. 75 kilograms).

In other embodiments, the second dose is stratified by patient body weight, i.e., the second dose is selected from a set of two or more doses stratified by patient body weight (e.g., 1,000 mg of drug for patients having a body weight ≦75 kg and 1,200 mg of drug for patients having a body weight >75 kg), and the first dose is greater in moles of drug than the largest dose of the set of patient body weight-stratified doses.

In still other embodiments, the second dose is a fixed dose, and the first dose is greater than the second dose in moles of drug.

In one non-limiting example, the invention provides any of the oral pharmaceutical compositions used to administer orally a known synthetic IFN-α receptor polypeptide agonist, hyperglycosylated polypeptide variant or hyperglycosylated, protease-resistant polypeptide variant in a method of treatment described in "Treatment Methods Using IFN-α" below.

In another non-limiting example, the invention provides any of the oral pharmaceutical compositions used to administer orally a known a subject synthetic IFN-β receptor polypeptide agonist, a known hyperglycosylated polypeptide variant or a known hyperglycosylated, protease-resistant polypeptide variant in a method of treatment described in "Treatment Methods Using IFN-β" below.

In another non-limiting example, the invention provides any of the oral pharmaceutical compositions used to administer orally a known synthetic IFN-γ receptor polypeptide agonist, hyperglycosylated polypeptide variant or hyperglycosylated, protease-resistant polypeptide variant in a method of treatment described in "Treatment Methods Using IFN-γ" below.

Oral Formulations with a Peptide Carrier

Additional oral formulations suitable for use herein include a known subject synthetic Type I interferon receptor polypeptide variant, a known hyperglycosylated polypeptide variant, or a known hyperglycosylated, protease-resistant polypeptide variant formulated with a carrier for oral delivery as described in WO 03/066859. Also included are oral formulations of erythropoietin and darbepoetin alfa formulated with a carrier for oral delivery. For example, a suitable oral formulation includes a desired synthetic Type I interferon receptor polypeptide agonist, a hyperglycosylated polypeptide variant or a hyperglycosylated, protease-resistant polypeptide variant or erythropoietin or darbepoetin alfa; and a penetrating peptide (also referred to as a "peptide carrier"). A penetrating peptide is any peptide that facilitates translocation of a substance across a biological barrier, e.g., the epithelial layer lining the gastrointestinal tract. Suitable peptide carriers include those derived from various proteins including, but not limited to, an integral membrane protein, a bacterial toxin, a non-pathogenic bacterium, a viral protein, an extracellular protein, and the like. The amino acid sequence of the peptide carrier can be the same as the amino acid sequence of a naturally-occurring peptide, or may be an altered version of such a peptide (e.g., including one or more amino acid substitutions compared to a naturally-occurring peptide).

Peptide carriers are typically from about 10 amino acids to about 30 amino acids in length, e.g., from about 10 amino acids to about 15 amino acids, from about 15 amino acids to about 20 amino acids, from about 20 amino acids to about 25 amino acids, or from about 25 amino acids to about 30 amino acids in length.

Suitable peptide carriers include, but are not limited to, any one of peptides 1-34, as shown in Table 9, below (SEQ ID NOs:1311-1326).

TABLE 9

| Peptide/Organism | Sequence |
|---|---|
| Peptide 1: from ORF HI0638 Haemophilus influenzae | NYHDIVLALAGVCQSAKLVHQLA |
| Peptide 2: from PM1850 Pasteurella nucliocida | NYYDITLALAAGVCQAAKLVQQFA |
| Peptide 3: from YCFC Escerichia coli | NYYDITLALAAGICQSARLVQQLA |
| Peptide 4: from VC1127 Vibrio cholerae | AIYDRTIAFAGICQAVALVQQVA |
| Peptide 5: from BU262 Buchnera aphidicola | KIHLITSLAGICQSAHLVQQLA |
| Peptide 6: from PA2627 Pseudomonus aeruginosa | DPRQQLIALGAVFESAALVDKLA |
| Pepilde 7: from XFI439 Xylelia fastidiosa | LIDNRVLALAGVVQALQQVRQIA |
| Peptide 8: from MLR0187 Rhizobium loti | NLPPIVLAVIGICAAVFLLQQYV |
| Peptide 9: from Human NK-2 Receptor | NYFIVNLALADLCMAAFNAAFNF |
| Peptide 10: from CPN0710/C Chlamydia pneumoniae | TAFDFNKMLDGVCTYVKGVQQYL |
| Peptide 11: from MLR4119 Rhizobium loti | RAILIPLALAGLCQVARAGDISS |
| Peptide 12:from NprB Bacilius subtilis | MRNLTKSLLLAGLCTAAQMVFVTH |
| Peptide 13: from Pilin Kingella dentrificans | IELMIVIAIIGILAAIALPAYQEYV |
| Peptide 14: from Pilin Eikenella carrodens | IELMIVIAIIGILAAIALPAYQDYV |
| Peptide 15: from zonula oceludens toxia (ZOT) | ASFGFCIGRLCVQDGF |
| Peptide 29: from Human NK-1 Receptor | NYFLVNLAFAEASMAAFNTVVNF |
| Peptide 30: from YCFC Escherichia coli | MNYYDTLALAGICQSARLVQQLA |

TABLE 9-continued

| Peptide/Organism | Sequence |
|---|---|
| Peptide 31: from YCPC Escherchia coli | MYYDITLALAGICQSARLVQQLA |
| Peptide 32: from YCPC Esherichia coli | MYDITLALAGICQSARLVQQLA |
| Peptide 33: from NprB Bacillusa subtilis | MRNLTRTSLLLAGICTAAQMVFV |
| Peptide 34: from ORF HI0638 Haemophilius influenzae | NYHDIVLALAGVCQSARLVHQLA |

Suitable peptide carriers also include variants of any one of peptides 1-34 as shown in Table 9, e.g., a variant which differs from any one of peptides 1-34 by from about one amino acid to about 5 amino acids; and fragments of any one of peptides 1-34. Variants of any one of peptides 1-34 include those having from about one to about five conservative amino acid substitutions, and/or non-conservative amino acid substitutions compared to the amino acid sequence of any one of peptides 1-34. Fragments of any one of peptides 1-34 include fragments containing from about 10 contiguous amino acids to about 15 contiguous amino acids, fragments containing from about 15 contiguous amino acids to about 20 contiguous amino acids, and fragments containing from about 20 contiguous amino acids to about 25 contiguous amino acids, of any one of peptides 1-34.

The peptide carrier may be "associated with" (also referred to as "fused to," "coupled to," "linked to," or "attached to") a desired synthetic Type I interferon receptor, a hyperglycosylated, a protease-resistant, or a hyperglycosylated, protease-resistant protein or erythropoietin or darbepoetin alfa in any of a number of ways, including, e.g., via a covalent interaction, an ionic interaction, a hydrophobic interaction, a hydrogen bond, or other type of association (e.g., van der Waal interaction; a non-specific association due to solvent preference; and the like). Attachment of a peptide carrier to a desired protein is achieved by any chemical, biochemical, enzymatic, or genetic coupling method known to those skilled in the art.

If the peptide carrier is coupled to the desired synthetic Type I interferon receptor, a hyperglycosylated or a hyperglycosylated, protease-resistant protein, or erythropoietin or darbepoetin alfa, typically the N-terminus of the desired protein is coupled to the carboxyl terminus of the peptide carrier. A desired synthetic Type I interferon receptor, a hyperglycosylated or a hyperglycosylated, protease-resistant protein, or erythropoietin or darbepoetin alfa may be coupled to the peptide carrier directly or indirectly via a covalent bond. For example, the covalent bond may be a peptide bond; or the covalent bond may be achieved by a homo- or a heterofunctional bridging reagent. The bridging reagent may be a succinimidyl-(N-maleimidomethyl)cyclohexane-1-carboxylate (SMCC)-type carrier. The covalent bond may be achieved using a peptide linker.

In some embodiments, a desired synthetic Type I interferon receptor, a hyperglycosylated or a hyperglycosylated, protease-resistant protein or erythropoietin or darbepoetin alfa is coupled to the peptide carrier via a linker peptide, which may be cleavable. The linker peptide may have any of a variety of amino acid sequences. Proteins can be joined by a spacer peptide, generally of a flexible nature, although other chemical linkages are not excluded. Currently, it is contemplated that the most useful linker sequences will generally be peptides of between about 6 and about 40 amino acids in length, or between about 6 and about 25 amino acids in length. These linkers are generally produced by using synthetic, linker-encoding oligonucleotides to couple the proteins. Peptide linkers with a degree of flexibility will generally be preferred. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use according to the present invention.

Amino acid sequences rich in alanine and proline residues are known to impart flexibility to multi-domain protein structures. For example, such sequences link the domains of the so-called E2 components of the 2-oxo acid dehydrogenase complexes, such as pyruvate dehydrogenase complex and. 2-oxo glutarate dehydrogenase complex. Alanine-proline rich regions are also found in myosin light chains. Exemplary linkers for use in the invention have a combination of glycine, alanine, proline and methionine residues, such as AAAGGM (SEQ ID NO:1332); AAAGGMPPAAAGGM (SEQ ID NO:1333); AAAGGM (SEQ ID NO:1334); and PPAAAGGM$_2$ (SEQ ID NO:1335). Other exemplary linker peptides include IEGR (SEQ ID NO:1336; which can be cleaved by factor Xa) and GGKGGK (SEQ ID NO:1337). However, any flexible linker generally between about 6 and about 40 amino acids in length may be used. Linkers may have virtually any sequence that results in a generally flexible peptide, including alanine-proline rich sequences of the type exemplified above.

In some embodiments, a desired synthetic Type I interferon receptor, a hyperglycosylated or a hyperglycosylated, protease-resistant protein is coupled to the peptide carrier via a linker peptide that is cleavable by an enzyme. In some embodiments, the enzyme is conditionally activated under a particular physiological condition.

In other embodiments, a desired synthetic Type I interferon receptor, a hyperglycosylated or a hyperglycosylated, protease-resistant protein is coupled to the peptide carrier via a non-covalent bond, where the non-covalent bond is achieved by an attachment of a hydrophobic moiety to the peptide carrier, such that the hydrophobic moiety enables the peptide carrier to be incorporated at the interface of a hydrophobic vesicle in which a desired synthetic Type I interferon receptor, a hyperglycosylated or a hyperglycosylated, protease-resistant polypeptide is contained. In other embodiments, the non-covalent bond is a non-covalent, high affinity bond, such as a biotin-avidin or a biotin-streptavidin bond.

Peptides may be synthesized chemically or enzymatically, may be produced recombinantly, may be isolated from a natural source, or a combination of the foregoing. Peptides may be isolated from natural sources using standard methods of protein purification known in the art, including, but not limited to, high-performance liquid chromatography, exclusion chromatography, gel electrophoresis, affinity chromatography, or other purification technique. One may employ solid phase peptide synthesis techniques, where such techniques are known to those of skill in the art. See Jones, *The Chemical Synthesis of Peptides* (Clarendon Press, Oxford) (11024). Generally, in such methods a peptide is produced through the sequential additional of activated monomeric units to a solid phase bound growing peptide chain. Well-established recombinant DNA techniques can be employed for production of peptides.

Exemplary oral formulations include enteric coated tablets and gelatin capsules that include a peptide carrier; a desired synthetic Type I interferon receptor, a hyperglycosylated or a hyperglycosylated, protease-resistant protein; and one or more of: a) a diluent, e.g., lactose, dextrose, sucrose, mannitol, sorbitol, cellulose and/or glycine; b) a protease inhibitor such as Aprotinin or trasylol; c) a lubricant, e.g., silica, talcum, stearic acid, its magnesium and/or calcium salt, poloxamer or polyethylene glycol; d) a binder (e.g., for tablets), e.g., magnesium aluminum silicate, starch paste, gelatin, tragacanth, methylcellulose, sodium carboxymethylcellulose and/or polyvinylpyrrolidone; e) an ionic surfactant active agent such as bile salts; f) a disintegrant, e.g., starches, agar, alginic acid or its sodium salt, or effervescent mixtures; and g) one or more of an absorbent, a colorant, a flavoring agent, and a sweetener. In some embodiments the oral formulation further comprises one or more of a preserving agent, a stabilizing agent, a wetting agent, an emulsifying agent, a solution promoter, a salt, and a buffer.

The oral formulations will in some embodiments further include one or more of a non-ionic detergent, an ionic detergent, a protease inhibitor, and a reducing agent. The non-ionic detergent may be a poloxamer such as Pluronic F-68; the ionic detergent may be a bile salt such as taurodeoxycholate; the protease inhibitor may be aprotinin or soy bean trypsin inhibitor; and the reducing agent may be N-acetyl-L-cysteine.

Combination Formulations

The present invention provides a pharmaceutical composition comprising a subject synthetic Type I interferon receptor polypeptide agonist that is glycosylated; a glycosylated IFN-γ; and a pharmaceutically acceptable excipient. In some embodiments, the subject glycosylated synthetic Type I interferon receptor polypeptide agonist and the glycosylated IFN-γ are co-formulated. In some embodiments, the subject glycosylated synthetic Type I interferon receptor polypeptide agonist and the glycosylated IFN-γ are co-formulated in a single liquid formulation that is contained in a single reservoir, for use in a drug delivery device. In some embodiments, the subject glycosylated synthetic Type I interferon receptor polypeptide agonist and the glycosylated IFN-γ are in a formulation suitable for delivery by injection. In other embodiments, the subject glycosylated synthetic Type I interferon receptor polypeptide agonist and the glycosylated IFN-γ are in a formulation suitable for oral delivery. Formulations suitable for oral delivery include those discussed above.

The present invention provides a pharmaceutical formulation comprising a single dose of a subject glycosylated synthetic Type I interferon receptor polypeptide agonist and a single dose of a glycosylated IFN-γ sufficient for use in any method described herein that employs the co-administration of a subject glycosylated synthetic Type I interferon receptor polypeptide agonist and a glycosylated IFN-γ in the treatment of a patient. In some aspects, the present invention provides a drug reservoir or other container containing a subject glycosylated synthetic Type I interferon receptor polypeptide agonist and a glycosylated IFN-γ co-formulated in a liquid, wherein both subject glycosylated synthetic Type I interferon receptor polypeptide agonist and glycosylated IFN-γ are present in the formulation in an amount suitable for one dose each. Dosage amounts are described herein. The reservoir can be provided in any of a variety of forms, including, but not limited to, a cartridge, a syringe, a reservoir of a continuous delivery device, and the like.

In some embodiments, a pharmaceutical composition comprising a subject glycosylated synthetic Type I interferon receptor polypeptide agonist and a glycosylated IFN-γ polypeptide is formed by admixture of (a) a pharmaceutical composition comprising the subject glycosylated synthetic Type I interferon receptor polypeptide agonist in a sterile water solution; and (b) a pharmaceutical composition comprising the glycosylated IFN-γ in a sterile water solution.

Polynucleotides, Vectors, and Host Cells

The present invention further provides a polynucleotide ("nucleic acid") comprising a nucleotide sequence that encodes a subject synthetic Type I interferon receptor polypeptide agonist, vectors comprising a subject polynucleotide, and host cells comprising a subject polynucleotide or vector. A subject polynucleotide is useful for generating a subject expression vector and genetically modified host cells, which are useful for producing a subject polypeptide agonist.

The subject invention provides nucleic acid compositions encoding a subject synthetic Type I interferon receptor polypeptide agonist. As used herein, the term "nucleic acid composition" refers to a composition comprising a sequence of a nucleic acid having an open reading frame that encodes a subject synthetic Type I interferon receptor polypeptide agonist, and is capable, under appropriate conditions, of being expressed such that a synthetic Type I interferon receptor polypeptide agonist is produced in a host cell comprising the nucleic acid. Also encompassed in this term are nucleic acids that are homologous or substantially similar or identical to the nucleic acids encoding a subject synthetic Type I interferon receptor polypeptide agonist.

Thus, the subject invention provides nucleic acids comprising a nucleotide sequence encoding a subject synthetic Type I interferon receptor polypeptide agonist, and nucleic acids having substantial nucleotide sequence identity to such nucleic acids (e.g., homologs). In many embodiments, a subject nucleic acid comprises a nucleotide sequence that encodes a subject synthetic Type I interferon receptor polypeptide agonist and that has at least about 75%, at least about 80%, at least about 85%, at least about 90%, at least about 95%, at least about 98%, or at least about 102%, or more, nucleotide sequence identity with a nucleotide sequence (particularly the subject polypeptide-encoding region of the nucleotide sequence) encoding a subject synthetic Type I interferon receptor polypeptide agonist.

In some embodiments, a subject nucleic acid comprises a nucleotide sequence encoding a synthetic Type I interferon receptor polypeptide agonist comprising an amino acid sequence as set forth in any one of SEQ ID NOs:1363-1373. In some embodiments, a subject nucleic acid comprises a nucleotide sequence as set forth in any one of SEQ ID NOs: 1376-1386.

In some embodiments, a subject nucleic acid comprises a nucleotide sequence encoding a synthetic Type I interferon receptor polypeptide agonist comprising an amino acid sequence as set forth in any one of SEQ ID NOs:1407-1421.

In some embodiments, a subject nucleic acid comprises a nucleotide sequence encoding a synthetic Type I interferon receptor polypeptide agonist comprising an amino acid sequence as set forth in any one of SEQ ID NOs:1423-1433.

In some embodiments, a subject nucleic acid comprises a nucleotide sequence encoding a synthetic Type I interferon receptor polypeptide agonist comprising an amino acid sequence as set forth in any one of SEQ ID NOs:1439-1449.

In some embodiments, a subject nucleic acid comprises a nucleotide sequence encoding a synthetic Type I interferon receptor polypeptide agonist comprising an amino acid sequence as set forth in any one of SEQ ID NOs:1455-1469.

In some embodiments, a subject nucleic acid comprises a nucleotide sequence encoding a synthetic Type I interferon receptor polypeptide agonist comprising an amino acid sequence as set forth in any one of SEQ ID NOs:1471-1485.

In some embodiments, a subject nucleic acid comprises a nucleotide sequence encoding a synthetic Type I interferon receptor polypeptide agonist comprising an amino acid sequence as set forth in any one of SEQ ID NOs:1487-1501.

In some embodiments, a subject nucleic acid comprises a nucleotide sequence encoding a synthetic Type I interferon receptor polypeptide agonist comprising an amino acid sequence as set forth in any one of SEQ ID NOs:1503-1517.

In some embodiments, a subject nucleic acid comprises a nucleotide sequence encoding a synthetic Type I interferon receptor polypeptide agonist comprising an amino acid sequence as set forth in any one of SEQ ID NOs:1519-1533.

In some embodiments, a subject nucleic acid comprises a nucleotide sequence encoding a synthetic Type I interferon receptor polypeptide agonist comprising an amino acid sequence as set forth in any one of SEQ ID NOs:1535-1549.

In some embodiments, a subject nucleic acid comprises a nucleotide sequence encoding a synthetic Type I interferon receptor polypeptide agonist comprising an amino acid sequence as set forth in any one of SEQ ID NOs:1551-1565.

In some embodiments, a subject nucleic acid comprises a nucleotide sequence encoding a synthetic Type I interferon receptor polypeptide agonist comprising an amino acid sequence as set forth in any one of SEQ ID NOs:1567-1581.

In some embodiments, a subject nucleic acid comprises a nucleotide sequence encoding a synthetic Type I interferon receptor polypeptide agonist comprising an amino acid sequence as set forth in any one of SEQ ID NOs:1585-1592.

In some embodiments, a subject nucleic acid comprises a nucleotide sequence encoding a synthetic Type I interferon receptor polypeptide agonist comprising an amino acid sequence as set forth in any one of SEQ ID NOs:1599-1613.

In some embodiments, a subject nucleic acid comprises a nucleotide sequence encoding a synthetic Type I interferon receptor polypeptide agonist comprising an amino acid sequence as set forth in any one of SEQ ID NOs:1615-1629.

In some embodiments, a subject nucleic acid comprises a nucleotide sequence encoding a synthetic Type I interferon receptor polypeptide agonist comprising an amino acid sequence as set forth in any one of SEQ ID NOs:1631-1645.

In some embodiments, a subject nucleic acid comprises a nucleotide sequence encoding a synthetic Type I interferon receptor polypeptide agonist comprising an amino acid sequence as set forth in any one of SEQ ID NOs:1647-1656.

In some embodiments, a subject nucleic acid comprises a nucleotide sequence encoding a synthetic Type I interferon receptor polypeptide agonist comprising an amino acid sequence as set forth in any one of SEQ ID NOs:1663-1677.

In some embodiments, a subject nucleic acid comprises a nucleotide sequence encoding a synthetic Type I interferon receptor polypeptide agonist comprising an amino acid sequence as set forth in any one of SEQ ID NOs:1679-1693.

In some embodiments, a subject nucleic acid comprises a nucleotide sequence encoding a synthetic Type I interferon receptor polypeptide agonist comprising an amino acid sequence as set forth in any one of SEQ ID NOs:1695-1706.

In some embodiments, a subject nucleic acid comprises a nucleotide sequence encoding a synthetic Type I interferon receptor polypeptide agonist comprising an amino acid sequence as set forth in any one of SEQ ID NOs:1711-1725.

In some embodiments, a subject nucleic acid comprises a nucleotide sequence encoding a synthetic Type I interferon receptor polypeptide agonist comprising an amino acid sequence as set forth in any one of SEQ ID NOs:1727-1738.

In some embodiments, a subject nucleic acid comprises a nucleotide sequence encoding a synthetic Type I interferon receptor polypeptide agonist comprising an amino acid sequence as set forth in any one of SEQ ID NOs:1743-1757.

Sequence similarity is calculated based on a reference sequence, which may be a subset of a larger sequence, such as a conserved motif, coding region, flanking region, etc. A reference sequence will usually be at least about 18 nt long, more usually at least about 30 nt long, and may extend to the complete sequence that is being compared. Algorithms for sequence analysis are known in the art, such as BLAST, described in Altschul et al. (11020), *J. Mol. Biol.* 215:403-10 (using default settings, i.e. parameters w=4 and T=17).

Also provided are nucleic acids that hybridize to the above-described nucleic acids under stringent conditions. An example of stringent hybridization conditions is hybridization at 50° C. or higher and 0.1×SSC (15 mM sodium chloride/1.5 mM sodium citrate). Another example of stringent hybridization conditions is overnight incubation at 42° C. in a solution: 50% formamide, 5×SSC (150 mM NaCl, 15 mM trisodium citrate), 50 mM sodium phosphate (pH 7.6), 5× Denhardt's solution, 10% dextran sulfate, and 20 μg/ml denatured, sheared salmon sperm DNA, followed by washing the filters in 0.1×SSC at about 65° C. Stringent hybridization conditions are hybridization conditions that are at least as stringent as the above representative conditions. Other stringent hybridization conditions are known in the art and may also be employed to identify nucleic acids of this particular embodiment of the invention.

Nucleic acids encoding the proteins and polypeptides of the subject invention are in many embodiments DNA, including cDNA. The term "synthetic Type I interferon receptor polypeptide agonist nucleic acid," as used herein, refers to the open reading frame encoding specific subject polypeptides, as well as adjacent 5' and 3' non-coding nucleotide sequences involved in the regulation of expression, e.g., from about 100 bp up to about 20 kb beyond the coding region, but possibly further in either direction. The nucleic acid may be introduced into an appropriate vector for extrachromosomal maintenance or for integration into a host genome, as described in greater detail below.

The nucleic acid compositions of the subject invention may encode all or a part of the subject synthetic Type I interferon receptor polypeptide agonists. Double or single stranded fragments may be obtained from the DNA sequence by chemically synthesizing oligonucleotides in accordance with conventional methods, by restriction enzyme digestion, by polymerase chain reaction (PCR) amplification, etc.

In some embodiments, a subject nucleic acid is prepared by chemical synthesis, e.g. by using an oligonucleotide synthesizer, wherein oligonucleotides are designed based on the amino acid sequence of the desired polypeptide, and in many embodiments, selecting those codons that are favored in the host cell in which the recombinant polypeptide will be produced. For example, several small oligonucleotides coding for portions of the desired polypeptide may be synthesized and assembled by PCR, ligation or ligation chain reaction (LCR). The individual oligonucleotides typically contain 5' or 3' overhangs for complementary assembly. Once assembled, the nucleotide sequence encoding the subject polypeptide is inserted into a recombinant vector and operably linked to control sequences necessary for expression of the subject nucleic acid, and subsequent production of the subject polypeptide, in the desired transformed host cell.

In some embodiments, a subject nucleic acid is generated such that at least about 10%, at least about 20%, at least about 30%, at least about 40%, at least about 50%, at least about 60%, at least about 70%, at least about 80%, or at least about 90%, or more, of the codons are codons that are preferred in human sequences. See, e.g., Table 8, below.

The subject nucleic acid molecules are generally propagated by placing the molecule in a vector. Viral and non-viral vectors are used, including plasmids. The choice of plasmid will depend on the type of cell in which propagation is desired and the purpose of propagation. Certain vectors are useful for amplifying and making large amounts of the desired DNA sequence.

The present invention further provides recombinant vectors ("constructs") comprising a subject polynucleotide. Recombinant vectors include vectors used for propagation of a polynucleotide of the invention, and expression vectors. Recombinant vectors are useful for propagation of the subject polynucleotides (cloning vectors). A subject recombinant expression vector is useful for effecting expression of a subject polynucleotide in a cell, e.g., for production of a subject synthetic Type I interferon receptor polypeptide agonist. The choice of appropriate vector is well within the skill of the art. Many such vectors are available commercially.

Expression vectors are suitable for expression in cells in culture. These vectors will generally include regulatory sequences ("control sequences" or "control regions") which are necessary to effect the expression of a subject polynucleotide to which they are operably linked. Still other vectors are suitable for transfer and expression in cells in a whole organism or person.

Expression vectors generally have convenient restriction sites located near the promoter sequence to provide for the insertion of nucleic acid sequences encoding heterologous proteins. A selectable marker operative in the expression host may be present. Expression vectors may be used for the production of fusion proteins, where the exogenous fusion peptide provides additional functionality, i.e. increased protein synthesis, stability, reactivity with defined antisera, an enzyme marker, e.g. β-galactosidase, luciferase, etc.

Expression cassettes may be prepared that comprise a transcription initiation region, a promoter region (e.g., a promoter that is functional in a eukaryotic cell), a subject polynucleotide, and a transcriptional termination region. After introduction of the DNA, the cells containing the construct may be selected by means of a selectable marker, the cells expanded and then used for expression.

The expression cassettes may be introduced into a variety of vectors, e.g. plasmid, BAC, HAC, YAC, bacteriophage such as lambda, P1, M13, etc., animal or plant viruses, and the like, where the vectors are normally characterized by the ability to provide selection of cells comprising the expression vectors. The vectors may provide for extrachromosomal maintenance, particularly as plasmids or viruses, or for integration into the host chromosome. Where extrachromosomal maintenance is desired, an origin sequence is provided for the replication of the plasmid, which may be low- or high copy-number. A wide variety of markers are available for selection, particularly those that protect against toxins, more particularly against antibiotics. The particular marker that is chosen is selected in accordance with the nature of the host, where in some cases, complementation may be employed with auxotrophic hosts. Introduction of the DNA construct into a host cell may use any convenient method, e.g. conjugation, bacterial transformation, calcium-precipitated DNA, electroporation, fusion, transfection, infection with viral vectors, biolistics, etc.

General aspects of mammalian cell host system transformations have been described by Axel in U.S. Pat. No. 4,3102, 216 issued Aug. 16, 1983. Transformations into yeast are typically carried out according to the method of Van Solingen et al., J. Bact., 130: 946 (1977) and Hsiao et al., Proc. Natl. Acad. Sci. (USA), 76: 3829 (1979). Optimized methods for calcium phosphate transfection of eukaryotic host cells are described by Wurm and Jordan in U.S. Pat. Nos. 5,484,720 and 5,593,875. However, other methods for introducing DNA into cells such as by nuclear injection, electroporation, or by protoplast fusion may also be used.

The present invention further provides genetically modified host cells, which may be isolated host cells, comprising a subject polynucleotide, or, in some embodiments, a subject expression vector. Suitable host cells include prokaryotes such as *E. coli, B. subtilis*; eukaryotes, including insect cells in combination with baculovirus vectors, yeast cells, such as *Saccharomyces cerevisiae*, or cells of a higher organism such as vertebrates, including amphibians (e.g., *Xenopus laevis* oocytes), and mammals, particularly mammals, e.g. COS cells, CHO cells, HEK293 cells, MA-10 cells, and the like, may be used as the expression host cells. Host cells can be used for the purposes of propagating a subject polynucleotide, for production of a subject synthetic Type I interferon receptor polypeptide agonist. In many embodiments, the host cell is a eukaryotic host cell. In particular, the host cell is in many embodiments a eukaryotic host cell that is capable of glycosylating a protein.

The mammalian host cells used to produce a subject synthetic Type I interferon receptor polypeptide agonist can be cultured in a variety of media. Commercially available media such as Ham's F10 (Sigma), Minimal Essential Medium ((MEM), Sigma), RPMI-1640 (Sigma), and Dulbecco's Modified Eagle's Medium ((DMEM), Sigma) are suitable for culturing the host cells. In addition, any of the media described in Ham and Wallace, Meth. Enz., 58: 44 (1979), Bames and Sato, Anal Biochem., 102: 255 (1980), U.S. Pat. Nos. 4,767,704; 4,657,866; 4,927,762; or U.S. Pat. No. 4,560,655; WO 90/03430; WO 87/00195; U.S. Pat. Re. No. 30,985; or U.S. Pat. No. 5,122,469, the disclosures of all of which are incorporated herein by reference, may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleosides (such as adenosine and thymidine), antibiotics (such as Gentamycin™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

Antibody Compositions

Also provided are antibodies that bind specifically a subject synthetic Type I interferon receptor polypeptide agonist. Suitable antibodies are obtained by immunizing a host animal with peptides comprising all or a portion of the subject protein. Suitable host animals include mouse, rat sheep, goat, hamster, rabbit, etc. In many embodiments, a subject antibody is isolated; and in many embodiments a subject antibody is purified.

The immunogen may comprise the complete protein, or fragments and derivatives thereof. Exemplary immunogens comprise all or a part of the protein, where these residues contain the post-translation modifications found on the native target protein. Immunogens are produced in a variety of ways known in the art, e.g., expression of cloned genes using conventional recombinant methods, chemical synthesis of synthetic Type I interferon receptor polypeptide agonist polypeptides, etc.

For preparation of polyclonal antibodies, the first step is immunization of the host animal with the target protein, where the target protein will preferably be in substantially pure form, comprising less than about 1% contaminant. The immunogen may comprise the complete target protein, fragments or derivatives thereof. To increase the immune response of the host animal, the target protein may be combined with an adjuvant, where suitable adjuvants include alum, dextran, sulfate, large polymeric anions, oil and water emulsions, e.g. Freund's adjuvant, Freund's complete adjuvant, and the like. The target protein may also be conjugated to synthetic carrier proteins or synthetic antigens. A variety of hosts may be immunized to produce the polyclonal antibodies. Such hosts include rabbits, guinea pigs, rodents, e.g. mice, rats, sheep, goats, and the like. The target protein is administered to the host, usually intradermally, with an initial dosage followed by one or more, usually at least two, additional booster dosages. Following immunization, the blood from the host will be collected, followed by separation of the serum from the blood cells. The Ig present in the resultant antiserum may be further fractionated using known methods, such as ammonium salt fractionation, DEAE chromatography, and the like.

Monoclonal antibodies are produced by conventional techniques. Generally, the spleen and/or lymph nodes of an immunized host animal provide a source of plasma cells. The plasma cells are immortalized by fusion with myeloma cells to produce hybridoma cells. Culture supernatant from individual hybridomas is screened using standard techniques to identify those producing antibodies with the desired specificity. Suitable animals for production of monoclonal antibodies to the human protein include mouse, rat, hamster, etc. To raise antibodies against the mouse protein, the animal will generally be a hamster, guinea pig, rabbit, etc. The antibody may be purified from the hybridoma cell supernatants or ascites fluid by conventional techniques, e.g. affinity chromatography using protein bound to an insoluble support, protein A sepharose, etc.

The antibody may be produced as a single chain, instead of the normal multimeric structure. Single chain antibodies are described in Jost et al. (11024) *J. Biol. Chem.* 269:26267-73, and others. DNA sequences encoding the variable region of the heavy chain and the variable region of the light chain are ligated to a spacer encoding at least about 4 amino acids of small neutral amino acids, including glycine and/or serine. The protein encoded by this fusion allows assembly of a functional variable region that retains the specificity and affinity of the original antibody.

Also of interest in certain embodiments are humanized antibodies. Methods of humanizing antibodies are known in the art. The humanized antibody may be the product of an animal having transgenic human immunoglobulin constant region genes (see for example International Patent Applications WO 90/10077 and WO 90/04036). Alternatively, the antibody of interest may be engineered by recombinant DNA techniques to substitute the CH1, CH2, CH3, hinge domains, and/or the framework domain with the corresponding human sequence (see WO 92/02190).

The use of Ig cDNA for construction of chimeric immunoglobulin genes is known in the art (Liu et al. (1987) *Proc. Natl. Acad. Sci. USA* 84:3439 and (1987) *J. Immunol.* 139: 3521). mRNA is isolated from a hybridoma or other cell producing the antibody and used to produce cDNA. The cDNA of interest may be amplified by the polymerase chain reaction using specific primers (U.S. Pat. Nos. 4,683,195 and 4,683,202). Alternatively, a library is made and screened to isolate the sequence of interest. The DNA sequence encoding the variable region of the antibody is then fused to human constant region sequences. The sequences of human constant regions genes may be found in Kabat et al. (11021) *Sequences of Proteins of Immunological Interest*, N.I.H. publication no. 91-3242. Human C region genes are readily available from known clones. The choice of isotype will be guided by the desired effector functions, such as complement fixation, or activity in antibody-dependent cellular cytotoxicity. Exemplary isotypes are IgG1, IgG3 and IgG4. Either of the human light chain constant regions, kappa or lambda, may be used. The chimeric, humanized antibody is then expressed by conventional methods.

Antibody fragments, such as Fv, F(ab')$_2$ and Fab may be prepared by cleavage of the intact protein, e.g. by protease or chemical cleavage. Alternatively, a truncated gene is designed. For example, a chimeric gene encoding a portion of the F(ab')$_2$ fragment would include DNA sequences encoding the CH1 domain and hinge region of the H chain, followed by a translational stop codon to yield the truncated molecule.

Consensus sequences of H and L J regions may be used to design oligonucleotides for use as primers to introduce useful restriction sites into the J region for subsequent linkage of V region segments to human C region segments. C region cDNA can be modified by site directed mutagenesis to place a restriction site at the analogous position in the human sequence.

Expression vectors include plasmids, retroviruses, YACs, EBV derived episomes, and the like. A convenient vector is one that encodes a functionally complete human CH or CL immunoglobulin sequence, with appropriate restriction sites engineered so that any VH or VL sequence can be easily inserted and expressed. In such vectors, splicing usually occurs between the splice donor site in the inserted J region and the splice acceptor site preceding the human C region, and also at the splice regions that occur within the human CH exons. Polyadenylation and transcription termination occur at native chromosomal sites downstream of the coding regions. The resulting chimeric antibody may be joined to any strong promoter, including retroviral LTRs, e.g. SV-40 early promoter, (Okayama et al. (1983) *Mol. Cell. Bio.* 3:280), Rous sarcoma virus LTR (Gorman et al. (1982) *Proc. Natl. Acad. Sci. USA* 79:6777), and moloney murine leukemia virus LTR (Grosschedl et al. (1985) *Cell* 41:885); native Ig promoters, etc.

Diagnostic Uses

The synthetic Type I interferon receptor polypeptide agonists of the invention are unique research reagents which provide Type I interferon activity templates for use in chemical library screening, wherein the practitioner can use a signal transduction assay as an initial, high volume screen for agents that inhibit a broad array of Type I interferon activities similar to the Type I interferon activity pattern of a subject synthetic Type I interferon receptor polypeptide agonist. In this way, candidate agents likely to inhibit a broad spectrum of Type I interferon activities (similar to the activity profile of a subject synthetic Type I interferon receptor polypeptide agonist) can be obtained with ease, avoiding prohibitively expensive and logistically impossible numbers of viral growth inhibition assays or cell proliferation inhibition assays on large chemical libraries.

In one embodiment, the synthetic Type I interferon receptor polypeptide agonists of the invention are used to screen chemical libraries in a Kinase Receptor Activation (KIRA) Assay as described in WO 95/14930 (published 1 June 11025). The KIRA assay is suitable for use herein because ligand binding to the Type I interferon receptor complex in situ in on the surface of host cells expressing the receptor induces a rapid increase in the phosphorylation of tyrosine residues in the intracellular domains of both IFNAR1 and IFNAR2 components of the receptor as taught in Platanias and Colamonici, J. Biol. Chem., 269: 17761-17764 (11024). The level of tyrosine phosphorylation can be used as a measure of signal transduction. The effect of a library compound on the levels of tyrosine phosphorylation induced by a subject synthetic Type I interferon receptor polypeptide agonist in the KIRA assay is an indication of the compound's inhibitory activity against the broad array of Type I interferons mimicked by the subject synthetic Type I interferon receptor polypeptide agonist.

The KIRA assay suitable for use herein employs (a) a host cell that expresses the Type I interferon receptor (both IFNAR1 and IFNAR2 components of the receptor) and (b) the subject synthetic Type I interferon receptor polypeptide agonist, which defines the inhibitor profile of interest. Cells which naturally express the human Type I interferon receptor, such as the human Daudi cells and U-266 human myeloma cells described in Colamonici and Domanski, J. Biol. Chem. 268: 10895-108102 (11023), can be used. In addition, cells which are transfected with the IFNAR1 and IFNAR2 components and contain intracellular signaling proteins necessary for Type I interferon signal transduction, such as mouse L-929 cells as described in Domanski et al., J. Biol. Chem., 270: 21606-21611 (11025), can be used. In the KIRA assay, the candidate antagonist is incubated with the subject synthetic Type I interferon receptor polypeptide agonist to be tested, and the incubation mixture is contacted with the Type I interferon receptor-expressing host cells. The treated cells are lysed, and IFNAR2 protein in the cell lysate is immobilized by capture with solid phase anti-IFNAR2 antibody. Signal transduction is assayed by measuring the amount of tyrosine phosphorylation that exists in the intracellular domain (ICD) of captured IFNAR2 and the amount of tyrosine phosphorylation that exists in the intracellular domain of any co-captured IFNAR1. Alternatively, cell lysis and immunoprecipitation can be performed under denaturing conditions in order to avoid co-capture of IFNAR1 and permit measurement of IFNAR2 tyrosine phosphorylation alone, e.g. as described in Platanias et al., J. Biol. Chem., 271: 23630-23633 (11026). The level of tyrosine phosphorylation can be accurately measured with labeled anti-phosphotyrosine antibody, which identifies phosphorylated tyrosine residues.

In another embodiment, a host cell coexpressing IFNAR1 and a chimeric construct containing IFNAR2 fused at its carboxy terminus to an affinity handle polypeptide is used in the KIRA assay. The chimeric IFNAR2 construct permits capture of the construct from cell lysate by use of a solid phase capture agent (in place of an anti-IFNAR2 antibody) specific for the affinity handle polypeptide. In a preferred embodiment, the affinity handle polypeptide is Herpes simplex virus glycoprotein D (gD) and the capture agent is an anti-gD monoclonal antibody as described in Examples 2 and 3 of WO 95/14930.

In this system, the synthetic Type I interferon receptor polypeptide agonist of the invention that possesses the Type I interferon activity profile of interest is used as a standard for analysis of the tyrosine phosphorylation inhibition patterns generated by the members of the chemical library that is screened. The IFNAR2 ICD tyrosine phosphorylation pattern generated by the synthetic Type I interferon receptor polypeptide agonist standard is compared to the tyrosine phosphorylation patterns produced by the standard in the presence of library compounds, and patterns found to indicate inhibition of tyrosine phosphorylation identify candidate agents that are likely to inhibit a range of type I interferon activities similar to the spectrum of Type I interferon activities mimicked by the standard. Accordingly, the synthetic Type I interferon receptor polypeptide agonist of the invention provides a useful means to quickly and efficiently screen large chemical libraries for compounds likely to inhibit the particular spectrum of Type I interferon activities exhibited by the subject synthetic Type I interferon receptor polypeptide agonist.

In addition, the synthetic Type I interferon receptor polypeptide agonist of the invention are useful in diagnostic assays for Type I interferon receptor expression in specific cells or tissues. In these assays, the subject synthetic Type I interferon receptor polypeptide agonists are labeled as described below and/or immobilized on an insoluble matrix, which allows for the detection of Type I interferon receptor in a sample.

The subject synthetic Type I interferon receptor polypeptide agonists can be used for the detection of Type I interferon receptor in any one of a number of well known diagnostic assay methods. For example, a biological sample may be assayed for Type I interferon receptor by obtaining the sample from a desired source, admixing the sample with a subject synthetic Type I interferon receptor polypeptide agonist to allow the subject synthetic Type I interferon receptor polypeptide agonist to form agonist/Type I interferon receptor complex with any Type I interferon receptor present in the mixture, and detecting any agonist/Type I interferon receptor complex present in the mixture. The biological sample may be prepared for assay by methods known in the art that are suitable for the particular sample. The methods of admixing the sample with the subject synthetic Type I interferon receptor polypeptide agonist and the methods of detecting agonist/Type I interferon receptor complex are chosen according to the type of assay used. Such assays include competitive and sandwich assays, and steric inhibition assays. Competitive and sandwich methods employ a phase-separation step as an integral part of the method while steric inhibition assays are conducted in a single reaction mixture.

Analytical methods for Type I interferon receptor all use one or more of the following reagents: labeled Type I interferon receptor analogue, immobilized Type I interferon receptor analogue, labeled synthetic Type I interferon receptor polypeptide agonist, immobilized synthetic Type I interferon receptor polypeptide agonist and steric conjugates. The labeled reagents also are known as "tracers."

The label used is any detectable functionality that does not interfere with the binding of Type I interferon receptor and the subject synthetic Type I interferon receptor polypeptide agonist. Numerous labels are known for use in immunoassay, examples including moieties that may be detected directly, such as fluorochrome, chemiluminescent, and radioactive labels, as well as moieties, such as enzymes, that must be reacted or derivatized to be detected. Examples of such labels include the radioisotopes $^{32}P$, $^{14}C$, $^{125}I$, $^{3}H$, and $^{131}I$, fluorophores such as rare earth chelates or fluorescein and its derivatives, rhodamine and its derivatives, dansyl, umbelliferone, luceriferases, e.g., firefly luciferase and bacterial luciferase (U.S. Pat. No. 4,737,456), luciferin, 2,3-dihydrophthalazinediones, horseradish peroxidase (HRP), alkaline phosphatase, β-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

Conventional methods are available to bind these labels covalently to proteins or polypeptides. For instance, coupling agents such as dialdehydes, carbodiimides, dimaleimides, bis-imidates, bis-diazotized benzidine, and the like may be used to tag the antibodies with the above-described fluorescent, chemiluminescent, and enzyme labels. See, for example, U.S. Pat. No. 3,940,475 (fluorimetry) and U.S. Pat. No. 3,645,090 (enzymes); Hunter et al., Nature, 144: 945 (1962); David et al., Biochemistry, 13: 1014-1021 (1974); Pain et al., J. Immunol. Methods, 40: 219-230 (1981); and Nygren, J. Histochem. and Cytochem., 30: 407-412 (1982). Preferred labels herein are enzymes such as horseradish peroxidase and alkaline phosphatase.

The conjugation of such label, including the enzymes, to the antibody is a standard manipulative procedure for one of ordinary skill in immunoassay techniques. See, for example, O'Sullivan et al., "Methods for the Preparation of Enzyme-antibody Conjugates for Use in Enzyme Immunoassay," in Methods in Enzymology, ed. J. J. Langone and H. Van Vunakis, Vol. 73 (Academic Press, New York, N.Y., 1981), pp. 147-166.

Immobilization of reagents is required for certain assay methods. Immobilization entails separating the synthetic Type I interferon receptor polypeptide agonist from any Type I interferon receptor that remains free in solution. This conventionally is accomplished by either insolubilizing the synthetic Type I interferon receptor polypeptide agonist or Type I interferon receptor analogue before the assay procedure, as by adsorption to a water-insoluble matrix or surface (Bennich et al., U.S. Pat. No. 3,720,760), by covalent coupling (for example, using glutaraldehyde cross-linking), or by insolubilizing the synthetic Type I interferon receptor polypeptide agonist or Type I interferon receptor analogue afterward, e.g., by immunoprecipitation.

Other assay methods, known as competitive or sandwich assays, are well established and widely used in the commercial diagnostics industry.

Competitive assays rely on the ability of a tracer Type I interferon receptor analogue to compete with the test sample Type I interferon receptor for a limited number of synthetic Type I interferon receptor polypeptide agonist binding sites. The synthetic Type I interferon receptor polypeptide agonist generally is insolubilized before or after the competition and then the tracer and Type I interferon receptor bound to the synthetic Type I interferon receptor polypeptide agonist are separated from the unbound tracer and Type I interferon receptor. This separation is accomplished by decanting (where the binding partner was preinsolubilized) or by centrifuging (where the binding partner was precipitated after the competitive reaction). The amount of test sample Type I interferon receptor is inversely proportional to the amount of bound tracer as measured by the amount of marker substance. Dose-response curves with known amounts of Type I interferon receptor are prepared and compared with the test results to quantitatively determine the amount of Type I interferon receptor present in the test sample. These assays are called ELISA systems when enzymes are used as the detectable markers.

Another species of competitive assay, called a "homogeneous" assay, does not require a phase separation. Here, a conjugate of an enzyme with the Type I interferon receptor is prepared and used such that when synthetic Type I interferon receptor polypeptide agonist binds to the Type I interferon receptor the presence of the synthetic Type I interferon receptor polypeptide agonist modifies the enzyme activity. In this case, the Type I interferon receptor or its immunologically active fragments are conjugated with a bifunctional organic bridge to an enzyme such as peroxidase. Conjugates are selected for use with synthetic Type I interferon receptor polypeptide agonist so that binding of the synthetic Type I interferon receptor polypeptide agonist inhibits or potentiates the enzyme activity of the label. This method per se is widely practiced under the name of EMIT.

Steric conjugates are used in steric hindrance methods for homogeneous assay. These conjugates are synthesized by covalently linking a low-molecular-weight hapten to a small Type I interferon receptor fragment so that antibody to hapten is substantially unable to bind the conjugate at the same time as synthetic Type I interferon receptor polypeptide agonist. Under this assay procedure the Type I interferon receptor present in the test sample will bind synthetic Type I interferon receptor polypeptide agonist, thereby allowing anti-hapten to bind the conjugate, resulting in a change in the character of the conjugate hapten, e.g., a change in fluorescence when the hapten is a fluorophore.

Sandwich assays particularly are useful for the determination of Type I interferon receptor in a sample. In sequential sandwich assays an immobilized synthetic Type I interferon receptor polypeptide agonist is used to adsorb test sample Type I interferon receptor, the test sample is removed as by washing, the bound Type I interferon receptor is used to adsorb a labeled anti-Type I interferon receptor antibody and bound material is then separated from residual tracer. The amount of bound tracer is directly proportional to test sample Type I interferon receptor. In "simultaneous" sandwich assays the test sample is not separated before adding the labeled anti-Type I interferon receptor antibody.

The foregoing are merely exemplary diagnostic assays for Type I interferon receptor. Other methods now or hereafter developed that use synthetic Type I interferon receptor polypeptide agonist for the determination of Type I interferon receptor are included within the scope hereof, including the bioassays described above.

Therapeutic Methods

The present invention provides method of treating fibrotic disorders. The subject methods generally involve administering to an individual in need thereof an effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. In some embodiments, a subject treatment method further includes administering at least one additional anti-fibrotic agent.

The present invention further provides methods of treating cancer. The subject methods generally involve administering to an individual in need thereof an effective amount of a subject synthetic Type I interferon receptor polypeptide agonist, a hyperglycosylated polypeptide variant, a protease-resistant polypeptide variant, or a hyperglycosylated, protease-resistant polypeptide variant. In some embodiments, a subject method further includes administering at least one additional anti-cancer agent.

The present invention additionally provides methods of treating viral infection. The subject methods generally involve administering to an individual in need thereof an effective amount of a subject synthetic Type I interferon receptor polypeptide agonist, a hyperglycosylated polypeptide variant, a protease-resistant polypeptide variant, or a hyperglycosylated, protease-resistant polypeptide variant. In some embodiments, a subject method further includes administering at least one additional anti-viral agent.

In some embodiments, a subject treatment method further includes administering a side effect management agent, to treat a side effect induced by a therapeutic agent.

Fibrotic Disorders

The present invention provides methods for treating a fibrotic disorder in an individual having a fibrotic disorder. The method generally involves administering an effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. The methods provide for treatment of fibrotic diseases, including those affecting the lung such as idiopathic pulmonary fibrosis, pulmonary fibrosis from a known etiology, liver fibrosis or cirrhosis, cardiac fibrosis, and renal fibrosis. The etiology may be due to any acute or chronic insult including toxic, metabolic, genetic and infectious agents.

Fibrosis is generally characterized by the pathologic or excessive accumulation of collagenous connective tissue. Fibrotic disorders include, but are not limited to, collagen disease, interstitial lung disease, human fibrotic lung disease (e.g., obliterative bronchiolitis, idiopathic pulmonary fibrosis, pulmonary fibrosis from a known etiology, tumor stroma in lung disease, systemic sclerosis affecting the lungs, Hermansky-Pudlak syndrome, coal worker's pneumoconiosis, asbestosis, silicosis, chronic pulmonary hypertension, AIDS-associated pulmonary hypertension, sarcoidosis, and the like), fibrotic vascular disease, arterial sclerosis, atherosclerosis, varicose veins, coronary infarcts, cerebral infarcts, myocardial fibrosis, musculoskeletal fibrosis, post-surgical adhesions, human kidney disease (e.g., nephritic syndrome, Alport's syndrome, HIV-associated nephropathy, polycystic kidney disease, Fabry's disease, diabetic nephropathy, chronic glomerulonephritis, nephritis associated with systemic lupus, and the like), cutis keloid formation, progressive systemic sclerosis (PSS), primary sclerosing cholangitis (PSC), liver fibrosis, liver cirrhosis, renal fibrosis, pulmonary fibrosis, cystic fibrosis, chronic graft versus host disease, scleroderma (local and systemic), Grave's opthalmopathy, diabetic retinopathy, glaucoma, Peyronie's disease, penis fibrosis, urethrostenosis after the test using a cystoscope, inner accretion after surgery, scarring, myelofibrosis, idiopathic retroperitoneal fibrosis, peritoneal fibrosis from a known etiology, drug-induced ergotism, fibrosis incident to benign or malignant cancer, fibrosis incident to microbial infection (e.g., viral, bacterial, parasitic, fungal, etc.), Alzheimer's disease, fibrosis incident to inflammatory bowel disease (including stricture formation in Crohn's disease and microscopic colitis), fibrosis induced by chemical or environmental insult (e.g., cancer chemotherapy, pesticides, radiation (e.g., cancer radiotherapy), and the like), and the like.

In some embodiments, effective amounts of a synthetic Type I interferon receptor polypeptide agonist and a Type II interferon receptor agonist are any combined dosage that, when administered to an individual having a fibrotic disorder, is effective to reduce fibrosis or reduce the rate of progression of fibrosis by at least about 10%, at least about 15%, at least about 20%, at least about 25%, at least about 30%, at least about 35%, at least about 40%, at least about 45%, or at least about 50%, or more, compared with the degree of fibrosis in the individual prior to treatment or compared to the rate of progression of fibrosis that would have been experienced by the patient in the absence of treatment.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that, when administered to an individual having a fibrotic disorder, is effective to increase, or to reduce the rate of deterioration of, at least one function of the organ affected by fibrosis (e.g., lung, liver, kidney, etc.) by at least about 10%, at least about 15%, at least about 20%, at least about 25%, at least about 30%, at least about 35%, at least about 40%, at least about 45%, or at least about 50%, or more, compared to the baseline level of organ function in the individual prior to treatment or compared to the rate of deterioration in organ function that would have been experienced by the individual in the absence of treatment.

Methods of measuring the extent of fibrosis in a given organ, and methods of measuring the function of any given organ, are well known in the art.

Idiopathic Pulmonary Fibrosis

The present invention provides methods of treating idiopathic pulmonary fibrosis (IPF). The methods generally involve administering to an individual having IPF effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist.

In some embodiments, a diagnosis of IPF is confirmed by the finding of usual interstitial pneumonia (UIP) on histopathological evaluation of lung tissue obtained by surgical biopsy. The criteria for a diagnosis of IPF are known. Ryu et al. (11028) *Mayo Clin. Proc.* 73:1085-1101.

In other embodiments, a diagnosis of IPF is a definite or probable IPF made by high resolution computer tomography (HRCT). In a diagnosis by HRCT, the presence of the following characteristics is noted: (1) presence of reticular abnormality and/or traction bronchiectasis with basal and peripheral predominance; (2) presence of honeycombing with basal and peripheral predominance; and (3) absence of atypical features such as micronodules, peribronchovascular nodules, consolidation, isolated (non-honeycomb) cysts, ground glass attenuation (or, if present, is less extensive than reticular opacity), and mediastinal adenopathy (or, if present, is not extensive enough to be visible on chest x-ray). A diagnosis of definite IPF is made if characteristics (1), (2), and (3) are met. A diagnosis of probable IPF is made if characteristics (1) and (3) are met.

In some embodiments, "effective amounts" of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are a combined dosage that is effective to decrease disease progression by at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or more, compared with a placebo control or an untreated control.

Disease progression is the occurrence of one or more of the following: (1) a decrease in predicted FVC of 10% or more; (2) an increase in A-a gradient of 5 mm Hg or more; (3) a decrease of 15% of more in single breath $DL_{co}$. Whether disease progression has occurred is determined by measuring one or more of these parameters on two consecutive occasions 4 to 14 weeks apart, and comparing the value to baseline.

Thus, e.g., where an untreated or placebo-treated individual exhibits a 50% decrease in FVC over a period of time, an individual administered with an effective combination of a synthetic Type I interferon receptor polypeptide agonist and a Type II interferon receptor agonist exhibits a decrease in FVC of 45%, about 42%, about 40%, about 37%, about 35%, about 32%, about 30%, or less, over the same time period.

In some embodiments, "effective amounts" of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to increase progression-free survival time, e.g., the time from baseline (e.g., a time point from 1 day to 28 days before beginning of treatment) to death or disease progression is increased by at least about 10%, at least about 20%, at least about 25%, at least about 30%, at least about 40%, at least about 50%, at least about 60%, at least about 70%, at least about 80%, at least about 90%, at least about 2-fold, at least about 3-fold, at least about 4-fold, at least about 5-fold, or more, compared a placebo-treated or an untreated control individual. Thus, e.g., in some embodiments effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to increase the progression-free survival time by at least about 1 week, at least about 2 weeks, at least about 3 weeks, at least about 4 weeks, at least about 2 months, at least about 3 months, at least about 4 months, at least about 5 months, at least about 6 months, at least about 8 months, at least about 10 months, at least about 12 months, at least about 18 months, at least about 2 years, at least about 3 years, or longer, compared to a placebo-treated or untreated control.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to increase at least one parameter of lung function, e.g., a combined dosage that increases at least one parameter of lung function by at least about 10%, at least about 20%, at least about 25%, at least about 30%, at least about 40%, at least about 50%, at least about 60%, at least about 70%, at least about 80%, at least about 90%, at least about 2-fold, at least about 3-fold, at least about 4-fold, at least about 5-fold, or more, compared to an untreated individual or a placebo-treated control individual. In some of these embodiments, a determination of whether a parameter of lung function is increased is made by comparing the baseline value with the value at any time point after the beginning of treatment, e.g., 48 weeks after the beginning of treatment, or between two time points, e.g., about 4 to about 14 weeks apart, after the beginning of treatment.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to increase the FVC by at least about 10% at least about 20%, at least about 25%, at least about 30%, at least about 40%, at least about 50%, at least about 60%, at least about 70%, at least about 80%, at least about 90%, at least about 2-fold, at least about 3-fold, at least about 4-fold, at least about 5-fold, or more compared to baseline on two consecutive occasions 4 to 14 weeks apart.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that results in a decrease in alveolar:arterial (A-a) gradient of at least about 5 mm Hg, at least about 7 mm Hg, at least about 10 mm Hg, at least about 12 mm Hg, at least about 15 mm Hg, or more, compared to baseline.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that increases the single breath $DL_{co}$ by at least about 15%, at least about 20%, at least about 30%, at least about 40%, at least about 50%, at least about 60%, at least about 70%, at least about 80%, at least about 90%, at least about 2-fold, at least about 3-fold, at least about 4-fold, at least about 5-fold, or more, compared to baseline. $CL_{co}$ is the lung diffusing capacity for carbon monoxide, and is expressed as mL CO/mm Hg/second.

Parameters of lung function include, but are not limited to, forced vital capacity (FVC); forced expiratory volume ($FEV_1$); total lung capacity; partial pressure of arterial oxygen at rest; partial pressure of arterial oxygen at maximal exertion.

Lung function can be measured using any known method, including, but not limited to spirometry.

Liver Fibrosis

The present invention provides methods of treating liver fibrosis, including reducing clinical liver fibrosis, reducing the likelihood that liver fibrosis will occur, and reducing a parameter associated with liver fibrosis. The methods generally involve administering a combination of an effective amount of a subject synthetic Type I interferon receptor polypeptide agonist, a hyperglycosylated polypeptide variant, a protease-resistant polypeptide variant, or a hyperglycosylated, protease-resistant polypeptide variant and an effective amount of a Type II interferon receptor agonist to an individual in need thereof. Of particular interest in many embodiments is treatment of humans.

Liver fibrosis is a precursor to the complications associated with liver cirrhosis, such as portal hypertension, progressive liver insufficiency, and hepatocellular carcinoma. A reduction in liver fibrosis thus reduces the incidence of such complications. Accordingly, the present invention further provides methods of reducing the likelihood that an individual will develop complications associated with cirrhosis of the liver.

The present methods generally involve administering therapeutically effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. As used herein, "effective amounts" of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective in reducing liver fibrosis or reducing the rate of progression of liver fibrosis; and/or that is effective in reducing the likelihood that an individual will develop liver fibrosis; and/or that is effective in reducing a parameter associated with liver fibrosis; and/or that is effective in reducing a disorder associated with cirrhosis of the liver.

The invention also provides a method for treatment of liver fibrosis in an individual comprising administering to the individual an amount of a subject synthetic Type I interferon receptor polypeptide agonist, a hyperglycosylated polypeptide variant, a protease-resistant polypeptide variant, or a hyperglycosylated, protease-resistant polypeptide variant and an amount of Type II interferon receptor agonist that in combination are effective for prophylaxis or therapy of liver fibrosis in the individual, e.g., increasing the probability of survival, reducing the risk of death, ameliorating the disease burden or slowing the progression of disease in the individual.

Whether treatment with a combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is effective in reducing liver fibrosis is determined by any of a number of well-established techniques for measuring liver fibrosis and liver function. Whether liver fibrosis is reduced is determined by analyzing a liver biopsy sample. An analysis of a liver biopsy comprises assessments of two major components: necroinflammation assessed by "grade" as a measure of the severity and ongoing disease activity, and the lesions of fibrosis and parenchymal or vascular remodeling as assessed by "stage" as being reflective of long-term disease progression. See, e.g., Brunt (2000) *Hepatol.* 31:241-246; and METAVIR (11024) *Hepatology* 20:15-20. Based on analysis of the liver biopsy, a score is assigned. A number of standardized scoring systems exist which provide a quantitative assessment of the degree and severity of fibrosis. These include the METAVIR, Knodell, Scheuer, Ludwig, and Ishak scoring systems.

The METAVIR scoring system is based on an analysis of various features of a liver biopsy, including fibrosis (portal fibrosis, centrilobular fibrosis, and cirrhosis); necrosis (piecemeal and lobular necrosis, acidophilic retraction, and ballooning degeneration); inflammation (portal tract inflammation, portal lymphoid aggregates, and distribution of portal inflammation); bile duct changes; and the Knodell index (scores of periportal necrosis, lobular necrosis, portal inflammation, fibrosis, and overall disease activity). The definitions of each stage in the METAVIR system are as follows: score: 0, no fibrosis; score: 1, stellate enlargement of portal tract but without septa formation; score: 2, enlargement of portal tract with rare septa formation; score: 3, numerous septa without cirrhosis; and score: 4, cirrhosis.

Knodell's scoring system, also called the Hepatitis Activity Index, classifies specimens based on scores in four categories of histologic features: I. Periportal and/or bridging necrosis; II. Intralobular degeneration and focal necrosis; III. Portal inflammation; and IV. Fibrosis. In the Knodell staging system, scores are as follows: score: 0, no fibrosis; score: 1, mild fibrosis (fibrous portal expansion); score: 2, moderate fibrosis; score: 3, severe fibrosis (bridging fibrosis); and score: 4, cirrhosis. The higher the score, the more severe the liver tissue damage. Knodell (1981) *Hepatol.* 1:431.

In the Scheuer scoring system scores are as follows: score: 0, no fibrosis; score: 1, enlarged, fibrotic portal tracts; score: 2, periportal or portal-portal septa, but intact architecture; score: 3, fibrosis with architectural distortion, but no obvious cirrhosis; score: 4, probable or definite cirrhosis. Scheuer (11021) *J Hepatol.* 13:372.

The Ishak scoring system is described in Ishak (11025) *J. Hepatol.* 22:696-6102. Stage 0, No fibrosis; Stage 1, Fibrous expansion of some portal areas, with or without short fibrous septa; stage 2, Fibrous expansion of most portal areas, with or without short fibrous septa; stage 3, Fibrous expansion of most portal areas with occasional portal to portal (P-P) bridging; stage 4, Fibrous expansion of portal areas with marked bridging (P-P) as well as portal-central (P-C); stage 5, Marked bridging (P-P and/or P-C) with occasional nodules (incomplete cirrhosis); stage 6, Cirrhosis, probable or definite. The benefit of anti-fibrotic therapy can also be measured and assessed by using the Child-Pugh scoring system which comprises a multicomponent point system based upon abnormalities in serum bilirubin level, serum albumin level, prothrombin time, the presence and severity of ascites, and the presence and severity of encephalopathy. Based upon the presence and severity of abnormality of these parameters, patients may be placed in one of three categories of increasing severity of clinical disease: A, B, or C.

In some embodiments, a therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is any combined dosage that effects a change of one unit or more in the fibrosis stage based on pre- and post-therapy liver biopsies. In particular embodiments, a therapeutically effective combined dosage reduces liver fibrosis by at least one unit in the METAVIR, the Knodell, the Scheuer, the Ludwig, or the Ishak scoring system.

Secondary, or indirect, indices of liver function can also be used to evaluate the efficacy of treatment with a subject synthetic Type I interferon receptor polypeptide agonist, a hyperglycosylated polypeptide variant, a protease-resistant polypeptide variant, or a hyperglycosylated, protease-resistant polypeptide variant and Type II interferon receptor agonist. Morphometric computerized semi-automated assessment of the quantitative degree of liver fibrosis based upon specific staining of collagen and/or serum markers of liver fibrosis can also be measured as an indication of the efficacy of a subject treatment method. Secondary indices of liver function include, but are not limited to, serum transaminase levels, prothrombin time, bilirubin, platelet count, portal pressure, albumin level, and assessment of the Child-Pugh score.

In another embodiment, an effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is any combined dosage that is effective to increase an index of liver function by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, or more, compared to the index of liver function in an untreated individual, or in a placebo-treated individual. Those skilled in the art can readily measure such indices of liver function, using standard assay methods, many of which are commercially available, and are used routinely in clinical settings.

Serum markers of liver fibrosis can also be measured as an indication of the efficacy of a subject treatment method. Serum markers of liver fibrosis include, but are not limited to, hyaluronate, N-terminal procollagen III peptide, 7S domain of type IV collagen, C-terminal procollagen I peptide, and laminin. Additional biochemical markers of liver fibrosis include α-2-macroglobulin, haptoglobin, gamma globulin, apolipoprotein A, and gamma glutamyl transpeptidase.

In another embodiment, a therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is any combined dosage that is effective to reduce a serum level of a marker of liver fibrosis by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, or more, compared to the level of the marker in an untreated individual, or in a placebo-treated individual. Those skilled in the art can readily measure such serum markers of liver fibrosis, using standard assay methods, many of which are commercially available, and are used routinely in clinical settings. Methods of measuring serum markers include immunological-based methods, e.g., enzyme-linked immunosorbent assays (ELISA), radioimmunoassays, and the like, using antibody specific for a given serum marker.

Quantitative tests of functional liver reserve can also be used to assess the efficacy of treatment with a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. These include: indocyanine green clearance (ICG), galactose elimination capacity (GEC), aminopyrine breath test (ABT), antipyrine clearance, monoethylglycine-xylidide (MEG-X) clearance, and caffeine clearance.

As used herein, a "complication associated with cirrhosis of the liver" refers to a disorder that is a sequellae of decompensated liver disease, i.e., or occurs subsequently to and as a result of development of liver fibrosis, and includes, but it not limited to, development of ascites, variceal bleeding, portal hypertension, jaundice, progressive liver insufficiency, encephalopathy, hepatocellular carcinoma, liver failure requiring liver transplantation, and liver-related mortality.

In another embodiment, a therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is any combined dosage that is effective in reducing the incidence of (e.g., the likelihood that an individual will develop) a disorder associated with cirrhosis of the liver by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, or at least about 80%, or more, compared to an untreated individual, or in a placebo-treated individual.

Whether combination therapy with a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is effective in reducing the incidence of a disorder associated with cirrhosis of the liver can readily be determined by those skilled in the art.

Reduction in liver fibrosis increases liver function. Thus, the invention provides methods for increasing liver function, generally involving administering a therapeutically effective combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. Liver functions include, but are not limited to, synthesis of proteins such as serum proteins (e.g., albumin, clotting factors, alkaline phosphatase, aminotransferases (e.g., alanine transaminase, aspartate transaminase), 5'-nucleosidase, γ-glutaminyl-transpeptidase, etc.), synthesis of bilirubin, synthesis of cholesterol, and synthesis of bile acids; a liver metabolic function, including, but not limited to, carbohydrate metabolism, amino acid and ammonia metabolism, hormone metabolism, and lipid metabolism; detoxification of exogenous drugs; a hemodynamic function, including splanchnic and portal hemodynamics; and the like.

Whether a liver function is increased is readily ascertainable by those skilled in the art, using well-established tests of liver function. Thus, synthesis of markers of liver function such as albumin, alkaline phosphatase, alanine transaminase, aspartate transaminase, bilirubin, and the like, can be assessed by measuring the level of these markers in the serum, using standard immunological and enzymatic assays. Splanchnic circulation and portal hemodynamics can be measured by portal wedge pressure and/or resistance using standard methods. Metabolic functions can be measured by measuring the level of ammonia in the serum.

Whether serum proteins normally secreted by the liver are in the normal range can be determined by measuring the levels of such proteins, using standard immunological and enzymatic assays. Those skilled in the art know the normal ranges for such serum proteins. The following are non-limiting examples. The normal range of alanine transaminase is from about 7 to about 56 units per liter of serum. The normal range of aspartate transaminase is from about 5 to about 40 units per liter of serum. Bilirubin is measured using standard assays. Normal bilirubin levels are usually less than about 1.2 mg/dL. Serum albumin levels are measured using standard assays. Normal levels of serum albumin are in the range of from about 35 to about 55 g/L. Prolongation of prothrombin time is measured using standard assays. Normal prothrombin time is less than about 4 seconds longer than control.

In another embodiment, a therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist is any combined dosage that is effective to increase liver function by at least about 10%, at least about 20%, at least about 30%, at least about 40%, at least about 50%, at least about 60%, at least about 70%, at least about 80%, or more. For example, a therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist includes any combined dosage that is effective to reduce an elevated level of a serum marker of liver function by at least about 10%, at least about 20%, at least about 30%, at least about 40%, at least about 50%, at least about 60%, at least about 70%, at least about 80%, or more, or to reduce the level of the serum marker of liver function to within a normal range. A therapeutically effective combination of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist also includes any combined dosage effective to increase a reduced level of a serum marker of liver function by at least about 10%, at least about 20%, at least about 30%, at least about 40%, at least about 50%, at least about 60%, at least about 70%, at least about 80%, or more, or to increase the level of the serum marker of liver function to within a normal range.

Renal Fibrosis

The present invention provides methods of treating renal fibrosis. The methods generally involve administering to an individual having renal fibrosis effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist. As used herein, "effective amounts" of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective in reducing renal fibrosis; and/or that is effective in reducing the likelihood that an individual will develop renal fibrosis; and/or that is effective in reducing a parameter associated with renal fibrosis; and/or that is effective in reducing a disorder associated with fibrosis of the kidney.

In one embodiment, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is sufficient to reduce renal fibrosis, or reduce the rate of progression of renal fibrosis, by at least about 10%, at least about 15%, at least about 20%, at least about 25%, at least about 30%, at least about 35%, at least about 40%, at least about 45%, at least about 50%, compared to the degree of renal fibrosis in the individual prior to treatment, or compared to the rate of progression of renal fibrosis that would have been experienced by the patient in the absence of treatment.

Whether fibrosis is reduced in the kidney is determined using any known method. For example, histochemical analysis of kidney biopsy samples for the extent of ECM deposition and/or fibrosis is performed. Other methods are known in the art. See, e.g., Masseroli et al. (11028) *Lab. Invest.* 78:511-522; U.S. Pat. No. 6,214,542.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to increase kidney function by at least about 10%, at least about 15%, at least about 20%, at least about 25%, at least about 30%, at least about 35%, at least about 40%, at least about 45%, at least about 50%, compared to the baseline level of kidney function in the individual prior to treatment.

In some embodiments, effective amounts of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist are any combined dosage that is effective to slow the decline in kidney function by at least about 10%, at least about 15%, at least about 20%, at least about 25%, at least about 30%, at least about 35%, at least about 40%, at least about 45%, at least about 50%, compared to the decline in kidney function that would occur in the absence of treatment.

Kidney function can be measured using any known assay, including, but not limited to, plasma creatinine level (where normal levels are generally in a range of from about 0.6 to about 1.2 mg/dL); creatinine clearance (where the normal range for creatinine clearance is from about 97 to about 137 mL/minute in men, and from about 88 to about 128 mL/minute in women); the glomerular filtration rate (either calculated or obtained from inulin clearance or other methods), blood urea nitrogen (where the normal range is from about 7 to about 20 mg/dL); and urine protein levels.

Additional Anti-Fibrotic Agents

Any of the above-described combination therapies for the treatment of a fibrotic disorder can be modified to include co-administration of one or more additional anti-fibrotic agents. Accordingly, the present invention provides a method of treating a fibrotic disorder, generally involving administering a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist in combination therapy with at least one additional anti-fibrotic agent. Suitable additional anti-fibrotic agents include, but are not limited to, SAPK inhibitors (e.g., pirfenidone or pirfenidone analogs), TNF antagonists, TGF-β antagonists, endothelin receptor antagonists, and the like.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of an amount of a SAPK inhibitor (e.g., pirfenidone or a pirfenidone analog) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of an amount of a TNF antagonist (e.g., etanercept, infliximab, or adalimumab) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of an amount of a TGF-β antagonist (e.g., GLEEVEC) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of an amount of an endothelin receptor antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog) and a TNF antagonist (e.g., etancercept, infliximab, or adalimumab) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog) and a TGF-β antagonist (e.g., GLEEVEC) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog) and an endothelin receptor antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a TNF antagonist (e.g., etanercept, infliximab, or adalimumab) and a TGF-β antagonist (e.g., GLEEVEC) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a TNF antagonist (e.g., etanercept, infliximab, or adalimumab) and an endothelin receptor antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a TGF-β antagonist (e.g., GLEEVEC) and an endothelin receptor antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog), TNF antagonist (e.g., etanercept, infliximab, or adalimumab) and a TGF-β antagonist (e.g., GLEEVEC) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog), TNF antagonist (e.g., etanercept, infliximab, or adalimumab) and an endothelin antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of TNF antagonist (e.g., etanercept, infliximab, or adalimumab), TGF-β antagonist (e.g., GLEEVEC) and an endothelin antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog), TGF-β antagonist (e.g., GLEEVEC) and an endothelin antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient can be modified to include co-administration to the patient of a combined dosage of a SAPK inhibitor (e.g., pirfenidone or a pirfenidone analog), a TNF antagonist (e.g., etanercept, infliximab, or adalimumab), a TGF-β antagonist (e.g., GLEEVEC) and an endothelin antagonist (e.g., TRACLEER) effective to augment the anti-fibrotic effect of the synthetic Type I interferon receptor polypeptide agonist and Type II interferon receptor agonist combination therapy, for the desired treatment duration.

As non-limiting examples, any of the above-described treatment methods featuring therapy with a combined dosage of a subject synthetic Type I interferon receptor polypeptide agonist, a hyperglycosylated polypeptide variant, a protease-resistant polypeptide variant, or a hyperglycosylated, protease-resistant polypeptide variant and a Type II interferon receptor agonist effective for the treatment of a fibrotic disorder in a patient, with or without co-administration of one or more additional anti-fibrotic agent(s), can be further modified to include co-administration of an amount of N-acetylcysteine (NAC) effective to augment the anti-fibrotic effect of the combination therapy, for the desired treatment duration.

Cancer

The present invention provides a method of treating a proliferative disorder (e.g., cancer), the method generally involving administering to an individual in need thereof an effective amount of a subject synthetic Type I interferon receptor polypeptide agonist, a hyperglycosylated polypeptide variant, a protease-resistant polypeptide variant, or a hyperglycosylated, protease-resistant polypeptide variant.

The methods are effective to reduce the growth rate of a tumor by at least about 5%, at least about 10%, at least about 20%, at least about 25%, at least about 50%, at least about 75%, at least about 85%, or at least about 90%, up to total inhibition of growth of the tumor, when compared to a suitable control. Thus, in these embodiments, an "effective amount" of a subject synthetic Type I interferon receptor polypeptide agonist, a hyperglycosylated polypeptide variant, a protease-resistant polypeptide variant, or a hyperglycosylated, protease-resistant polypeptide variant is an amount that is sufficient to reduce tumor growth rate by at least about 5%, at least about 10%, at least about 20%, at least about 25%, at least about 50%, at least about 75%, at least about 85%, or at least about 90%, up to total inhibition of tumor growth, when compared to a suitable control. In an experimental animal system, a suitable control may be a genetically identical animal not treated with the synthetic Type I interferon receptor polypeptide agonist. In non-experimental systems, a suitable control may be the tumor load present before administering the synthetic Type I interferon receptor polypeptide agonist. Other suitable controls may be a placebo control.

Whether growth of a tumor is inhibited can be determined using any known method, including, but not limited to, a proliferation assay as described in the Example; a $^3$H-thymidine uptake assay; and the like.

The methods are useful for treating a wide variety of cancers, including carcinomas, sarcomas, leukemias, and lymphomas.

Carcinomas that can be treated using a subject method include, but are not limited to, esophageal carcinoma, hepatocellular carcinoma, basal cell carcinoma (a form of skin cancer), squamous cell carcinoma (various tissues), bladder carcinoma, including transitional cell carcinoma (a malignant neoplasm of the bladder), bronchogenic carcinoma, colon carcinoma, colorectal carcinoma, gastric carcinoma, lung carcinoma, including small cell carcinoma and non-small cell carcinoma of the lung, adrenocortical carcinoma, thyroid carcinoma, pancreatic carcinoma, breast carcinoma, ovarian carcinoma, prostate carcinoma, adenocarcinoma, sweat gland carcinoma, sebaceous gland carcinoma, papillary carcinoma, papillary adenocarcinoma, cystadenocarcinoma, medullary carcinoma, renal cell carcinoma, ductal carcinoma in situ or bile duct carcinoma, choriocarcinoma, seminoma, embryonal carcinoma, Wilm's tumor, cervical carcinoma, uterine carcinoma, testicular carcinoma, osteogenic carcinoma, epithelieal carcinoma, and nasopharyngeal carcinoma, etc.

Sarcomas that can be treated using a subject method include, but are not limited to, fibrosarcoma, myxosarcoma, liposarcoma, chondrosarcoma, chordoma, osteogenic sarcoma, osteosarcoma, angiosarcoma, endotheliosarcoma, lymphangiosarcoma, lymphangioendotheliosarcoma, synovioma, mesothelioma, Ewing's sarcoma, leiomyosarcoma, rhabdomyosarcoma, and other soft tissue sarcomas.

Other solid tumors that can be treated using a subject method include, but are not limited to, glioma, astrocytoma, medulloblastoma, craniopharyngioma, ependymoma, pinealoma, hemangioblastoma, acoustic neuroma, oligodendroglioma, menangioma, melanoma, neuroblastoma, and retinoblastoma.

Leukemias that can be treated using a subject method include, but are not limited to, a) chronic myeloproliferative syndromes (neoplastic disorders of multipotential hematopoietic stem cells); b) acute myelogenous leukemias (neoplastic transformation of a multipotential hematopoietic stem cell or a hematopoietic cell of restricted lineage potential; c) chronic lymphocytic leukemias (CLL; clonal proliferation of immunologically immature and functionally incompetent small lymphocytes), including B-cell CLL, T-cell CLL prolymphocytic leukemia, and hairy cell leukemia; and d) acute lymphoblastic leukemias (characterized by accumulation of lymphoblasts). Lymphomas that can be treated using a subject method include, but are not limited to, B-cell lymphomas (e.g., Burkitt's lymphoma); Hodgkin's lymphoma; and the like.

Combination Therapies

In some embodiments, the present invention provides combination therapies for the treatment of cancer. Accordingly, the present invention provides a method of treating cancer, generally involving administering a subject synthetic Type I interferon receptor polypeptide agonist, a hyperglycosylated polypeptide variant, a protease-resistant polypeptide variant, or a hyperglycosylated, protease-resistant polypeptide variant in combination therapy with at least a second therapeutic agent.

In other embodiments, the present invention provides methods of treating cancer that involve administering a synergistic combination of a subject synthetic Type I interferon receptor polypeptide agonist, a hyperglycosylated polypeptide variant, a protease-resistant polypeptide variant, or a hyperglycosylated, protease-resistant polypeptide variant and a second therapeutic agent. As used herein, a "synergistic combination" of a subject synthetic Type I interferon receptor polypeptide agonist, a hyperglycosylated polypeptide variant, a protease-resistant polypeptide variant, or a hyperglycosylated, protease-resistant polypeptide variant and a second therapeutic agent is a combined dosage that is more effective in the therapeutic or prophylactic treatment of cancer than the incremental improvement in treatment outcome that could be predicted or expected from a merely additive combination of (i) the therapeutic or prophylactic benefit of a subject synthetic Type I interferon receptor polypeptide agonist, a hyperglycosylated polypeptide variant, a protease-resistant polypeptide variant, or a hyperglycosylated, protease-resistant polypeptide variant when administered at that same dosage as a monotherapy and (ii) the therapeutic or prophylactic benefit of the second therapeutic agent when administered at the same dosage as a monotherapy.

In some embodiments, a subject synthetic Type I interferon receptor polypeptide agonist, a hyperglycosylated polypeptide variant, a protease-resistant polypeptide variant, or a hyperglycosylated, protease-resistant polypeptide variant is administered as an adjuvant therapy to a standard cancer therapy. Standard cancer therapies include surgery (e.g., surgical removal of cancerous tissue), radiation therapy, bone marrow transplantation, chemotherapeutic treatment, biological response modifier treatment, and certain combinations of the foregoing.

Radiation therapy includes, but is not limited to, x-rays or gamma rays that are delivered from either an externally applied source such as a beam, or by implantation of small radioactive sources.

Chemotherapeutic agents are non-peptidic (i.e., non-proteinaceous) compounds that reduce proliferation of cancer cells, and encompass cytotoxic agents and cytostatic agents. Non-limiting examples of chemotherapeutic agents include alkylating agents, nitrosoureas, antimetabolites, antitumor antibiotics, plant (vinca) alkaloids, and steroid hormones.

Agents that act to reduce cellular proliferation are known in the art and widely used. Such agents include alkylating agents, such as nitrogen mustards, nitrosoureas, ethylenimine derivatives, alkyl sulfonates, and triazenes, including, but not limited to, mechlorethamine, cyclophosphamide (Cytoxan™), melphalan (L-sarcolysin), carmustine (BCNU), lomustine (CCNU), semustine (methyl-CCNU), streptozocin, chlorozotocin, uracil mustard, chlormethine, ifosfamide, chlorambucil, pipobroman, triethylenemelamine, triethylenethiophosphoramine, busulfan, dacarbazine, and temozolomide.

Antimetabolite agents include folic acid analogs, pyrimidine analogs, purine analogs, and adenosine deaminase inhibitors, including, but not limited to, cytarabine (CYTOSAR-U), cytosine arabinoside, fluorouracil (5-FU), floxuridine (FudR), 6-thioguanine, 6-mercaptopurine (6-MP), pentostatin, 5-fluorouracil (5-FU), methotrexate, 10-propargyl-5,8-dideazafolate (PDDF, CB3717), 5,8-dideazatetrahydrofolic acid (DDATHF), leucovorin, fludarabine phosphate, pentostatine, and gemcitabine.

Suitable natural products and their derivatives, (e.g., vinca alkaloids, antitumor antibiotics, enzymes, lymphokines, and epipodophyllotoxins), include, but are not limited to, Ara-C, paclitaxel (Taxol®), docetaxel (Taxotere®), deoxycoformycin, mitomycin-C, L-asparaginase, azathioprine; brequinar; alkaloids, e.g. vincristine, vinblastine, vinorelbine, vindesine, etc.; podophyllotoxins, e.g. etoposide, teniposide, etc.; antibiotics, e.g. anthracycline, daunorubicin hydrochloride (daunomycin, rubidomycin, cerubidine), idarubicin, doxorubicin, epirubicin and morpholino derivatives, etc.; phenoxizone biscyclopeptides, e.g. dactinomycin; basic glycopeptides, e.g. bleomycin; anthraquinone glycosides, e.g. plicamycin (mithramycin); anthracenediones, e.g. mitoxantrone; azirinopyrrolo indolediones, e.g. mitomycin; macrocyclic immunosuppressants, e.g. cyclosporine, FK-506 (tacrolimus, prograf), rapamycin, etc.; and the like.

Other anti-proliferative cytotoxic agents are navelbene, CPT-11, anastrazole, letrazole, capecitabine, reloxafine, cyclophosphamide, ifosamide, and droloxafine.

Microtubule affecting agents that have antiproliferative activity are also suitable for use and include, but are not limited to, allocolchicine (NSC 406042), Halichondrin B (NSC 609395), colchicine (NSC 757), colchicine derivatives (e.g., NSC 33410), dolstatin 10 (NSC 376128), maytansine (NSC 153858), rhizoxin (NSC 332598), paclitaxel (Taxol®), Taxol® derivatives, docetaxel (Taxotere®), thiocolchicine (NSC 361792), trityl cysterin, vinblastine sulfate, vincristine sulfate, natural and synthetic epothilones including but not limited to, eopthilone A, epothilone B, discodermolide; estramustine, nocodazole, and the like.

Hormone modulators and steroids (including synthetic analogs) that are suitable for use include, but are not limited to, adrenocorticosteroids, e.g. prednisone, dexamethasone, etc.; estrogens and pregestins, e.g. hydroxyprogesterone caproate, medroxyprogesterone acetate, megestrol acetate, estradiol, clomiphene, tamoxifen; etc.; and adrenocortical suppressants, e.g. aminoglutethimide; 17α-ethinylestradiol; diethylstilbestrol, testosterone, fluoxymesterone, dromostanolone propionate, testolactone, methylprednisolone, methyl-testosterone, prednisolone, triamcinolone, chlorotrianisene, hydroxyprogesterone, aminoglutethimide, estramustine, medroxyprogesterone acetate, leuprolide, Flutamide (Drogenil), Toremifene (Fareston), and Zoladex®. Estrogens stimulate proliferation and differentiation, therefore compounds that bind to the estrogen receptor are used to block this activity. Corticosteroids may inhibit T cell proliferation.

Other chemotherapeutic agents include metal complexes, e.g. cisplatin (cis-DDP), carboplatin, etc.; ureas, e.g. hydroxyurea; and hydrazines, e.g. N-methylhydrazine; epidophyllotoxin; a topoisomerase inhibitor; procarbazine; mitoxantrone; leucovorin; tegafur; etc. Other anti-proliferative agents of interest include immunosuppressants, e.g. mycophenolic acid, thalidomide, desoxyspergualin, azasporine, leflunomide, mizoribine, azaspirane (SKF 105685); Iressa® (ZD 1839, 4-(3-chloro-4-fluorophenylamino)-7-methoxy-6-(3-(4-morpholinyl)propoxy)quinazoline); etc.

"Taxanes" include paclitaxel, as well as any active taxane derivative or pro-drug. "Paclitaxel" (which should be understood herein to include analogues, formulations, and derivatives such as, for example, docetaxel, TAXOL™, TAXOTERE™ (a formulation of docetaxel), 10-desacetyl analogs of paclitaxel and 3'N-desbenzoyl-3'N-t-butoxycarbonyl analogs of paclitaxel) may be readily prepared utilizing techniques known to those skilled in the art (see also WO 94/07882, WO 94/07881, WO 94/07880, WO 94/07876, WO 93/23555, WO 93/10076; U.S. Pat. Nos. 5,294,637; 5,283,253; 5,279,949; 5,274,137; 5,202,448; 5,200,534; 5,229,529; and EP 590,267), or obtained from a variety of commercial sources, including for example, Sigma Chemical Co., St. Louis, Mo. (T7402 from *Taxus brevifolia*; or T-1912 from *Taxus yannanensis*).

Paclitaxel should be understood to refer to not only the common chemically available form of paclitaxel, but analogs and derivatives (e.g., Taxotere™ docetaxel, as noted above) and paclitaxel conjugates (e.g., paclitaxel-PEG, paclitaxel-dextran, or paclitaxel-xylose).

Also included within the term "taxane" are a variety of known derivatives, including both hydrophilic derivatives, and hydrophobic derivatives. Taxane derivatives include, but not limited to, galactose and mannose derivatives described in International Patent Application No. WO 102/18113; piperazino and other derivatives described in WO 102/14209; taxane derivatives described in WO 102/09021, WO 98/22451, and U.S. Pat. No. 5,869,680; 6-thio derivatives described in WO 98/28288; sulfenamide derivatives described in U.S. Pat. No. 5,821,263; and taxol derivative described in U.S. Pat. No. 5,415,869. It further includes prodrugs of paclitaxel including, but not limited to, those described in WO 98/58927; WO 98/13059; and U.S. Pat. No. 5,824,701.

Biological response modifiers suitable for use in connection with the methods of the invention include, but are not limited to, (1) inhibitors of tyrosine kinase (RTK) activity; (2) inhibitors of serine/threonine kinase activity; (3) tumor-associated antigen antagonists, such as antibodies that bind specifically to a tumor antigen; (4) apoptosis receptor agonists; (5) interleukin-2; (6) IFN-α; (7) IFN-γ (8) colony-stimulating factors; and (9) inhibitors of angiogenesis.

In one aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is a tyrosine kinase inhibitor. In some embodiments, the tyrosine kinase inhibitor is a receptor tyrosine kinase (RTK) inhibitor, such as type I receptor tyrosine kinase inhibitors (e.g., inhibitors of epidermal growth factor receptors), type II receptor tyrosine kinase inhibitors (e.g., inhibitors of insulin receptor), type III receptor tyrosine kinase inhibitors (e.g., inhibitors of platelet-derived growth factor receptor), and type IV receptor tyrosine kinase inhibitors (e.g., fibroblast growth factor receptor). In other embodiments, the tyrosine kinase inhibitor is a non-receptor tyrosine kinase inhibitor, such as inhibitors of src kinases or janus kinases.

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is an inhibitor of a receptor tyrosine kinase involved in growth factor signaling pathway(s). In some embodiments, the inhibitor is genistein. In other embodiments, the inhibitor is an EGFR tyrosine kinase-specific antagonist, such as IRESSA™ gefitinib (ZD18398; Novartis), TARCEVA™ erolotinib (OSI-774; Roche; Genentech; OSI Pharmaceuticals), or tyrphostin AG1478 (4-(3-chloroanilino)-6,7-dimethoxyquinazoline. In still other embodiments, the inhibitor is any indolinone antagonist of Flk-1/KDR (VEGF-R2) tyrosine kinase activity described in U.S. Patent Application Publication No. 2002/0183364 A1, such as the indolinone antagonists of Flk-1/KDR (VEGF-R2) tyrosine kinase activity disclosed in Table 1 on pages 4-5 thereof. In further embodiments, the inhibitor is any of the substituted 3-[(4,5,6,7-tetrahydro-1H-indol-2-yl)methylene]-1,3-dihydroindol-2-one antagonists of Flk-1/KDR (VEGF-R2), FGF-R1 or PDGF-R tyrosine kinase activity disclosed in Sun, L., et al., *J. Med. Chem.*, 43(14): 2655-2663 (2000). In additional embodiments, the inhibitor is any substituted 3-[(3- or 4-carboxyethylpyrrol-2-yl)methylidenyl]indolin-2-one antagonist of Flt-1 (VEGF-R1), Flk-1/KDR (VEGF-R2), FGF-R1 or PDGF-R tyrosine kinase activity disclosed in Sun, L., et al., *J. Med. Chem.*, 42(25): 5120-5130 (11029).

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is an inhibitor of a non-receptor tyrosine kinase involved in growth factor signaling pathway(s). In some embodiments, the inhibitor is an antagonist of JAK2 tyrosine kinase activity, such as tyrphostin AG490 (2-cyano-3-(3,4-dihydroxyphenyl)-N-(benzyl)-2-propenamide). In other embodiments, the inhibitor is an antagonist of bcr-abl tyrosine kinase activity, such as GLEEVEC™ imatinib mesylate (STI-571; Novartis).

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is an inhibitor of one or more kinases involved in cell cycle regulation. In some embodiments, the inhibitor is an antagonist of CDK2 activation, such as tryphostin AG490 (2-cyano-3-(3,4-dihydroxyphenyl)-N-(benzyl)-2-propenamide). In other embodiments, the inhibitor is an antagonist of CDK1/cyclin B activity, such as alsterpaullone. In still other embodiments, the inhibitor is an antagonist of CDK2 kinase activity, such as indirubin-3'-monoxime. In additional embodiments, the inhibitor is an ATP pool antagonist, such as lometrexol (described in U.S. Patent Application Publication No. 2002/0156023 A1).

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is a tumor-associated antigen antagonist, such as an antibody antagonist. In some embodiments involving the treatment of HER2-expressing tumors, the tumor-associated antigen antagonist is an anti-HER2 monoclonal antibody, such as HERCEPTIN™ trastuzumab. In some embodiments involving the treatment of CD20-expressing tumors, such as B-cell lymphomas, the tumor-associated antigen antagonist is an anti-CD20 monoclonal antibody, such as RITUXAN™ rituximab.

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is a tumor growth factor antagonist. In some embodiments, the tumor growth factor antagonist is an antagonist of epidermal growth factor (EGF), such as an anti-EGF monoclonal antibody. In other embodiments, the tumor growth factor antagonist is an antagonist of epidermal growth factor receptor erbB1 (EGFR), such as an anti-EGFR monoclonal antibody inhibitor of EGFR activation or signal transduction, e.g. ERBITUX™ cetuximab.

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is an Apo-2 ligand agonist. In some embodiments, the Apo-2 ligand agonist is any of the Apo-2 ligand polypeptides described in WO 97/25428.

In another aspect, the invention contemplates the combination of a subject synthetic Type I interferon receptor polypeptide agonist, a hyperglycosylated polypeptide variant, a protease-resistant polypeptide variant, or a hyperglycosylated, protease-resistant polypeptide variant as an adjuvant to any therapy in which the cancer patient receives treatment with at least one additional antineoplastic drug, where the additional drug is an anti-angiogenic agent. In some embodiments, the anti-angiogenic agent is a vascular endothelial cell growth factor (VEGF) antagonist, such as an anti-VEGF monoclonal antibody, e.g. AVASTIN™ bevacizumab (Genentech). In other embodiments, the anti-angiogenic agent is an antagonist of VEGF-R1, such as an anti-VEGF-R1 monoclonal antibody. In other embodiments, the anti-angiogenic agent is an antagonist of VEGF-R2, such as an anti-VEGF-R2 monoclonal antibody. In other embodiments, the anti-angiogenic agent is an antagonist of basic fibroblast growth factor (bFGF), such as an anti-bFGF monoclonal antibody. In other embodiments, the anti-angiogenic factor is an antagonist of bFGF receptor, such as an anti-bFGF receptor monoclonal antibody. In other embodiments, the anti-angiogenic agent is an antagonist of TGF-β, such as an anti-TGF-β monoclonal antibody. In other embodiments, the anti-angiogenic agent is an antagonist of TGF-β receptor, such as an anti-TGF-P receptor monoclonal antibody. In other embodiments, the anti-angiogenic agent is a retinoic acid receptor (RXR) ligand, such as any RXR ligand described in U.S. Patent Application Publication No. 2001/0036955 A1 or in any of U.S. Pat. Nos. 5,824,685; 5,780,676; 5,3102,586;

5,466,861; 4,810,804; 5,770,378; 5,770,383; or 5,770,382. In still other embodiments, the anti-angiogenic agent is a peroxisome proliferator-activated receptor (PPAR) gamma ligand, such as any PPAR gamma ligand described in U.S. Patent Application Publication No. 2001/0036955 A1.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of cancer in a patient can be modified to include co-administration to the patient of an amount of IFN-γ effective to augment the anti-cancer effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of cancer in a patient can be modified to include co-administration to the patient of an amount of a SAPK inhibitor (e.g., pirfenidone or a pirfenidone analog) effective to augment the anti-cancer effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of cancer in a patient can be modified to include co-administration to the patient of an amount of IFN-γ and an amount of a SAPK inhibitor (e.g., pirfenidone or a pirfenidone analog) effective to augment the anti-cancer effect of the synthetic Type I interferon receptor polypeptide agonist therapy, for the desired treatment duration.

As non-limiting examples, any of the above-described treatment methods featuring combination therapy with an amount of a subject synthetic Type I interferon receptor polypeptide agonist, a hyperglycosylated polypeptide variant, a protease-resistant polypeptide variant, or a hyperglycosylated, protease-resistant polypeptide variant and an amount of an additional anti-cancer agent, other than IFN-γ, effective for the treatment of cancer in a patient can be modified to include co-administration to the patient of an amount of IFN-γ effective to augment the anti-cancer effect of the synthetic Type I interferon receptor polypeptide agonist and additional anti-cancer agent combination therapy, for the desired treatment duration.

As non-limiting examples, any of the above-described treatment methods featuring combination therapy with an amount of a subject synthetic Type I interferon receptor polypeptide agonist, a hyperglycosylated polypeptide variant, a protease-resistant polypeptide variant, or a hyperglycosylated, protease-resistant polypeptide variant and an amount of an additional anti-cancer agent, other than a SAPK inhibitor (e.g., pirfenidone or a pirfenidone analog), effective for the treatment of cancer in a patient can be modified to include co-administration to the patient of an amount of a SAPK inhibitor (e.g., pirfenidone or a pirfenidone analog) effective to augment the anti-cancer effect of the synthetic Type I interferon receptor polypeptide agonist and additional anti-cancer agent combination therapy, for the desired treatment duration.

As non-limiting examples, any of the above-described treatment methods featuring combination therapy with an amount of a subject synthetic Type I interferon receptor polypeptide agonist, a hyperglycosylated polypeptide variant, a protease-resistant polypeptide variant, or a hyperglycosylated, protease-resistant polypeptide variant and an amount of an additional anti-cancer agent, other than IFN-γ or a SAPK inhibitor (e.g., pirfenidone or a pirfenidone analog), effective for the treatment of cancer in a patient can be modified to include co-administration to the patient of an amount of IFN-γ and an amount of a SAPK inhibitor (e.g., pirfenidone or a pirfenidone analog) that are effective to augment the anti-cancer effect of the synthetic Type I interferon receptor polypeptide agonist and additional anti-cancer agent combination therapy, for the desired treatment duration.

Viral Infections

The present invention provides methods of treating a virus infection, and methods of reducing viral load, or reducing the time to viral clearance, or reducing morbidity or mortality in the clinical outcomes, in patients suffering from a virus infection. The present invention further provides methods of reducing the risk that an individual will develop a pathological viral infection that has clinical sequelae. The methods generally involve administering a therapeutically effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of a virus infection.

In some embodiments, a subject treatment method is prophylactic. Where a subject treatment method is prophylactic, the methods reduce the risk that an individual will develop pathological infection with a virus. An effective amount of a subject synthetic Type I interferon receptor polypeptide agonist, a hyperglycosylated polypeptide variant, a protease-resistant polypeptide variant, or a hyperglycosylated, protease-resistant polypeptide variant is an amount that reduces the risk or reduces the probability that an individual will develop a pathological infection with a virus. For example, an effective amount reduces the risk that an individual will develop a pathological infection by at least about 10%, at least about 20%, at least about 25%, at least about 30%, at least about 35%, at least about 40%, at least about 50%, at least about 60%, at least about 70%, at least about 80%, at least about 90%, or more, compared to the risk of developing a pathological infection with the virus in the absence of treatment with a subject agent.

In some embodiments, an effective amount of a subject synthetic Type I interferon receptor polypeptide agonist, a hyperglycosylated polypeptide variant, a protease-resistant polypeptide variant, or a hyperglycosylated, protease-resistant polypeptide variant is an amount that reduces viral load by at least about 10%, at least about 20%, at least about 25%, at least about 30%, at least about 35%, at least about 40%, at least about 50%, at least about 60%, at least about 70%, at least about 80%, at least about 90%, or more, compared to the viral load in the absence of treatment with the subject agent.

In some embodiments, an effective amount of a subject synthetic Type I interferon receptor polypeptide agonist, a hyperglycosylated polypeptide variant, a protease-resistant polypeptide variant, or a hyperglycosylated, protease-resistant polypeptide variant is an amount that that reduces the time to viral clearance, by at least about 10%, at least about 20%, at least about 25%, at least about 30%, at least about 35%, at least about 40%, at least about 50%, at least about 60%, at least about 70%, at least about 80%, at least about 90%, or more, compared to the time to viral clearance in the absence of treatment.

In some embodiments, an effective amount of a subject synthetic Type I interferon receptor polypeptide agonist, a hyperglycosylated polypeptide variant, a protease-resistant polypeptide variant, or a hyperglycosylated, protease-resistant polypeptide variant is an amount that reduces morbidity or mortality due to a virus infection by at least about 10%, at least about 20%, at least about 25%, at least about 30%, at least about 35%, at least about 40%, at least about 50%, at least about 60%, at least about 70%, at least about 80%, at least about 90%, or more, compared to the morbidity or mortality in the absence of treatment.

Whether a subject treatment method is effective in reducing the risk of a pathological virus infection, reducing viral load, reducing time to viral clearance, or reducing morbidity or mortality due to a virus infection is readily determined by those skilled in the art. Viral load is readily measured by measuring the titer or level of virus in serum. The number of virus in the serum can be determined using any known assay, including, e.g., a quantitative polymerase chain reaction assay using oligonucleotide primers specific for the virus being assayed. Whether morbidity is reduced can be determined by measuring any symptom associated with a virus infection, including, e.g., fever, respiratory symptoms (e.g., cough, ease or difficulty of breathing, and the like.)

In some embodiments, the present invention provides a method of reducing viral load, and/or reducing the time to viral clearance, and/or reducing morbidity or mortality in an individual who has been exposed to a virus (e.g., an individual who has come into contact with an individual infected with a virus), the method involving administering an effective amount of subject synthetic Type I interferon receptor polypeptide agonist. In these embodiments, therapy is begun from about 1 hour to about 14 days following exposure, e.g., from about 1 hour to about 24 hours, from about 24 hours to about 48 hours, from about 48 hours to about 3 days, from about 3 days to about 4 days, from about 4 days to about 7 days, from about 7 days to about 10 days, or from about 10 days to about 14 days following exposure to the virus.

In some embodiments, the present invention provides a method of reducing the risk that an individual who has been exposed to a virus (e.g., an individual who has come into contact with an individual infected with a virus) will develop a pathological virus infection with clinical sequelae, the method involving administering an effective amount of a subject synthetic Type I interferon receptor polypeptide agonist, a hyperglycosylated polypeptide variant, a protease-resistant polypeptide variant, or a hyperglycosylated, protease-resistant polypeptide variant. In these embodiments, therapy is begun from about 1 hour to about 35 days following exposure, e.g., from about 1 hour to about 24 hours, from about 24 hours to about 48 hours, from about 48 hours to about 3 days, from about 3 days to about 4 days, from about 4 days to about 7 days, from about 7 days to about 10 days, from about 10 days to about 14 days, from about 14 days to about 21 days, or from about 21 days to about 35 days following exposure to the virus.

In some embodiments, the present invention provides methods of reducing viral load, and/or reducing the time to viral clearance, and/or reducing morbidity or mortality in an individual who may or may not have been infected with a virus, and who has been exposed to a virus. In some of these embodiments, the methods involve administering an effective amount of a subject synthetic Type I interferon receptor polypeptide agonist, a hyperglycosylated polypeptide variant, a protease-resistant polypeptide variant, or a hyperglycosylated, protease-resistant polypeptide variant within 24 hours of exposure to the virus.

In some embodiments, the present invention provides methods of reducing viral load, and/or reducing the time to viral clearance, and/or reducing morbidity or mortality in an individual who has not been infected with a virus, and who has been exposed to a virus. In some of these embodiments, the methods involve administering effective amounts of a SAPK inhibitor (e.g., pirfenidone or a pirfenidone analog) and a Type I interferon receptor agonist within 48 hours of exposure to the virus.

In some embodiments, the present invention provides methods of reducing viral load, and/or reducing the time to viral clearance, and/or reducing morbidity or mortality in an individual who has not been infected with a virus, and who has been exposed to a virus. The methods involve administering a subject agent more than 48 hours after exposure to the virus, e.g., from 72 hours to about 35 days, e.g., 72 hours, 4 days, 5 days, 6 days, or 7 days after exposure, or from about 7 days to about 10 days, from about 10 days to about 14 days, from about 14 days to about 17 days, from about 17 days to about 21 days, from about 21 days to about 25 days, from about 25 days to about 30 days, or from about 30 days to about 35 days after exposure to the virus. In some of these embodiments, the methods involve administering an effective amount of a subject synthetic Type I interferon receptor polypeptide agonist, a hyperglycosylated polypeptide variant, a protease-resistant polypeptide variant, or a hyperglycosylated, protease-resistant polypeptide variant more than 48 hours after exposure to the virus.

In some embodiments, the present invention provides a method of reducing the risk that an individual who has been exposed to a virus will develop a pathological virus infection with clinical sequelae. In some of these embodiments, the methods involve administering an effective amount of a subject synthetic Type I interferon receptor polypeptide agonist, a hyperglycosylated polypeptide variant, a protease-resistant polypeptide variant, or a hyperglycosylated, protease-resistant polypeptide variant within 24 hours of exposure to the virus.

In some embodiments, the present invention provides a method of reducing the risk that an individual who has been exposed to a virus (e.g., an individual who has come into contact with an individual infected with a virus) will develop a pathological viral infection with clinical sequelae. In some of these embodiments, the methods involve administering an effective amount of a subject synthetic Type I interferon receptor polypeptide agonist, a hyperglycosylated polypeptide variant, a protease-resistant polypeptide variant, or a hyperglycosylated, protease-resistant polypeptide variant within 48 hours of exposure to the virus.

Hepatitis Virus Infection

The present invention provides methods of treating a hepatitis virus infection. In particular embodiments, the present invention provides methods of treating a hepatitis C virus (HCV) infection; methods of reducing the incidence of complications associated with HCV and cirrhosis of the liver; and methods of reducing viral load, or reducing the time to viral clearance, or reducing morbidity or mortality in the clinical outcomes, in patients suffering from HCV infection. The methods generally involve administering to the individual an effective amount of a subject synthetic Type I interferon receptor polypeptide agonist, a hyperglycosylated polypeptide variant, a protease-resistant polypeptide variant, or a hyperglycosylated, protease-resistant polypeptide variant.

In many embodiments, a subject treatment method is effective to decrease viral load in the individual, and to achieve a sustained viral response. Optionally, the subject method further provides administering to the individual an effective amount of a nucleoside analog, such as ribavirin, levovirin, and viramidine. Of particular interest in many embodiments is treatment of humans.

Whether a subject method is effective in treating an HCV infection can be determined by measuring viral load, or by measuring a parameter associated with HCV infection, including, but not limited to, liver fibrosis, elevations in serum transaminase levels, and necroinflammatory activity in the liver. Indicators of liver fibrosis are discussed in detail below.

Viral load can be measured by measuring the titer or level of virus in serum. These methods include, but are not limited to, a quantitative polymerase chain reaction (PCR) and a branched DNA (bDNA) test. Quantitative assays for measuring the viral load (titer) of HCV RNA have been developed. Many such assays are available commercially, including a quantitative reverse transcription PCR (RT-PCR) (Amplicor HCV Monitor™, Roche Molecular Systems, New Jersey); and a branched DNA (deoxyribonucleic acid) signal amplification assay (Quantiplex™ HCV RNA Assay (bDNA), Chiron Corp., Emeryville, Calif.). See, e.g., Gretch et al. (11025) *Ann. Intern. Med.* 123:321-329. Also of interest is a nucleic acid test (NAT), developed by Gen-Probe Inc. (San Diego) and Chiron Corporation, and sold by Chiron Corporation under the trade name Procleix®, which NAT simultaneously tests for the presence of HIV-1 and HCV. See, e.g., Vargo et al. (2002) *Transfusion* 42:876-885.

In general, an effective amount of a subject agent (e.g., a subject synthetic Type I interferon receptor polypeptide agonist, a hyperglycosylated polypeptide variant, a protease-resistant polypeptide variant, or a hyperglycosylated, protease-resistant polypeptide variant) is an amount that is effective to reduce viral load to undetectable levels, e.g., to less than about 5000, less than about 1000, less than about 500, or less than about 200 genome copies/mL serum. In some embodiments, an effective amount of a subject agent is an amount that is effective to reduce viral load to less than 100 genome copies/mL serum. In many embodiments, the methods of the invention achieve a sustained viral response, e.g., the viral load is reduced to undetectable levels for a period of at least about one month, at least about two months, at least about three months, at least about four months, at least about five months, or at least about six months following cessation of treatment.

Whether a subject method is effective in treating an HCV infection can be determined by measuring a parameter associated with HCV infection, such as liver fibrosis. Methods of determining the extent of liver fibrosis are discussed in detail below. In some embodiments, the level of a serum marker of liver fibrosis indicates the degree of liver fibrosis.

As one non-limiting example, levels of serum alanine aminotransferase (ALT) are measured, using standard assays. In general, an ALT level of less than about 45 international units is considered normal. In some embodiments, an effective amount of a therapeutic agent that is administered as part of a subject combination therapy is an amount effective to reduce ALT levels to less than about 45 U/ml serum.

Combination Therapies

In some embodiments, the present invention provides combination therapies for the treatment of a viral infection. Accordingly, the present invention provides a method of treating a viral infection, generally involving administering a subject synthetic Type I interferon receptor polypeptide agonist, a hyperglycosylated polypeptide variant, a protease-resistant polypeptide variant, or a hyperglycosylated, protease-resistant polypeptide variant in combination therapy with at least a second therapeutic agent. Suitable additional therapeutic agents include, but are not limited to, nucleoside analogs such as ribavirin and viramidine, L-nucleosides such as levovirin, Type II interferon receptor agonists (e.g., IFN-γ), TNF antagonists, thymosin-α, SAPK inhibitors (e.g., pirfenidone or pirfenidone analogs), amantidine, and the like. In connection with combination therapies for the treatment of HCV infection, suitable additional therapeutic agents include, but are not limited to, nucleoside analogs such as ribavirin, levovirin, and virarnidine, Type II interferon receptor agonists (e.g., IFN-γ), TNF antagonists, NS3 inhibitors, NS5B inhibitors, alpha-glucosidase inhibitors, thymosin-α, SAPK inhibitors (e.g., pirfenidone or pirfenidone analogs), amantidine, and the like.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of IFN-γ effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of a nucleoside analog effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of ribavirin effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of an L-nucleoside (e.g., levovirin) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of viramidine effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of a TNF antagonist (e.g. etanercept, infliximab or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection, e.g. HCV infection, in a patient can be modified to include co-administration to the patient of an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS3 inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS5B inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an alpha-glucosidase inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of a nucleoside analog effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of ribavirin effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of an L-nucleoside (e.g., levovirin) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of viramidine effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of IFN-γ and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of IFN-γ and an amount of an NS3 inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of IFN-γ and an amount of an NS5B inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of IFN-γ and an amount of an alpha-glucosidase inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of a nucleoside analog (e.g., ribavirin, viramidine, or an L-nucleoside such as levovirin) and an amount of IFN-γ effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of a nucleoside analog (e.g., ribavirin, viramidine, or an L-nucleoside such as levovirin) and an amount of TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of a nucleoside analog (e.g., ribavirin, viramidine, or an L-nucleoside such as levovirin) and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of viral infection (e.g., HCV infection) in a patient can be modified to include co-administration to the patient of an amount of a nucleoside analog (e.g., ribavirin, viramidine, or an L-nucleoside such as levovirin) and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of an NS3 inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of an NS5B inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS3 inhibitor and an amount of a TNF antagonist (e.g. etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS5B inhibitor and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an alpha-glucosidase inhibitor and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a SAPK inhibitor (e.g., pirfenidone or a pirfendione analog) and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of thymosin-α and an amount of a TNF antagonist (e.g., etanercept, infliximab, or adalimumab) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a SAPK inhibitor (e.g., pirfenidone or a pirfenidone analog) and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS3 inhibitor and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS5B inhibitor and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an alpha-glucosidase inhibitor and an amount of thymosin-α effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS3 inhibitor and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS5B inhibitor and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an alpha-glucosidase inhibitor and an amount of a SAPK inhibitor (e.g., pirfenidone or a pirfenidone analog) effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of a nucleoside analog (e.g., ribavirin, viramidine, or an L-nucleoside such as levovirin) and an amount of an alpha-glucosidase inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an NS5B inhibitor and an amount of an NS3 inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist, a hyperglycosylated polypeptide variant, a protease-resistant polypeptide variant, or a hyperglycosylated, protease-resistant polypeptide variant for the treatment of an HCV infection in a patient can be modified to include co-administration to the patient of an amount of an alpha-glucosidase inhibitor and an amount of an NS3 inhibitor effective to augment the anti-viral effect of the synthetic Type I interferon receptor polypeptide agonist therapy, for the desired treatment duration.

As non-limiting examples, any of the above-described treatment methods featuring therapy with an effective amount of a subject synthetic Type I interferon receptor polypeptide agonist for the treatment of an HCV infection in a patient can be modified to include co-administration to the patient of an amount of an NS5B inhibitor and an amount of an alpha-glucosidase inhibitor effective to augment the anti-viral effect of the synthetic Type I interferon receptor polypeptide agonist therapy, for the desired treatment duration.

Patient Identification

In certain embodiments, the specific regimen of drug therapy used in treatment of the HCV patient is selected according to certain disease parameters exhibited by the patient, such as the initial viral load, genotype of the HCV infection in the patient, liver histology and/or stage of liver fibrosis in the patient.

Thus, in some embodiments, the present invention provides any of the above-described methods for the treatment of HCV infection in which the subject method is modified to treat a treatment failure patient for a duration of 48 weeks.

In other embodiments, the invention provides any of the above-described methods for HCV in which the subject method is modified to treat a non-responder patient, where the patient receives a 48 week course of therapy.

In other embodiments, the invention provides any of the above-described methods for the treatment of HCV infection in which the subject method is modified to treat a relapser patient, where the patient receives a 48 week course of therapy.

In other embodiments, the invention provides any of the above-described methods for the treatment of HCV infection in which the subject method is modified to treat a naïve patient infected with HCV genotype 1, where the patient receives a 48 week course of therapy.

In other embodiments, the invention provides any of the above-described methods for the treatment of HCV infection in which the subject method is modified to treat a naïve patient infected with HCV genotype 4, where the patient receives a 48 week course of therapy.

In other embodiments, the invention provides any of the above-described methods for the treatment of HCV infection in which the subject method is modified to treat a naïve patient infected with HCV genotype 1, where the patient has a high viral load (HVL), where "HVL" refers to an HCV viral load of greater than $2 \times 10^6$ HCV genome copies per mL serum, and where the patient receives a 48 week course of therapy.

In one embodiment, the invention provides any of the above-described methods for the treatment of an HCV infection, where the subject method is modified to include the steps of (1) identifying a patient having advanced or severe stage liver fibrosis as measured by a Knodell score of 3 or 4 and then (2) administering to the patient the drug therapy of the subject method for a time period of about 24 weeks to about 60 weeks, or about 30 weeks to about one year, or about 36 weeks to about 50 weeks, or about 40 weeks to about 48 weeks, or at least about 24 weeks, or at least about 30 weeks, or at least about 36 weeks, or at least about 40 weeks, or at least about 48 weeks, or at least about 60 weeks.

In another embodiment, the invention provides any of the above-described methods for the treatment of an HCV infection, where the subject method is modified to include the steps of (1) identifying a patient having advanced or severe stage liver fibrosis as measured by a Knodell score of 3 or 4 and then (2) administering to the patient the drug therapy of the subject method for a time period of about 40 weeks to about 50 weeks, or about 48 weeks.

In another embodiment, the invention provides any of the above-described methods for the treatment of an HCV infection, where the subject method is modified to include the steps of (1) identifying a patient having an HCV genotype 1 infection and an initial viral load of greater than 2 million viral genome copies per ml of patient serum and then (2) administering to the patient the drug therapy of the subject method for a time period of about 24 weeks to about 60 weeks, or about 30 weeks to about one year, or about 36 weeks to about 50 weeks, or about 40 weeks to about 48 weeks, or at least about 24 weeks, or at least about 30 weeks, or at least about 36 weeks, or at least about 40 weeks, or at least about 48 weeks, or at least about 60 weeks.

In another embodiment, the invention provides any of the above-described methods for the treatment of an HCV infection, where the subject method is modified to include the steps of (1) identifying a patient having an HCV genotype 1 infection and an initial viral load of greater than 2 million viral genome copies per ml of patient serum and then (2) administering to the patient the drug therapy of the subject method for a time period of about 40 weeks to about 50 weeks, or about 48 weeks.

In another embodiment, the invention provides any of the above-described methods for the treatment of an HCV infection, where the subject method is modified to include the steps of (1) identifying a patient having an HCV genotype 1 infection and an initial viral load of greater than 2 million viral genome copies per ml of patient serum and no or early stage liver fibrosis as measured by a Knodell score of 0, 1, or 2 and then (2) administering to the patient the drug therapy of the subject method for a time period of about 24 weeks to about 60 weeks, or about 30 weeks to about one year, or about 36 weeks to about 50 weeks, or about 40 weeks to about 48 weeks, or at least about 24 weeks, or at least about 30 weeks, or at least about 36 weeks, or at least about 40 weeks, or at least about 48 weeks, or at least about 60 weeks.

In another embodiment, the invention provides any of the above-described methods for the treatment of an HCV infection, where the subject method is modified to include the steps of (1) identifying a patient having an HCV genotype 1 infection and an initial viral load of greater than 2 million viral genome copies per ml of patient serum and no or early stage liver fibrosis as measured by a Knodell score of 0, 1, or 2 and then (2) administering to the patient the drug therapy of the subject method for a time period of about 40 weeks to about 50 weeks, or about 48 weeks.

In another embodiment, the invention provides any of the above-described methods for the treatment of an HCV infection, where the subject method is modified to include the steps of (1) identifying a patient having an HCV genotype 1 infection and an initial viral load of less than or equal to 2 million viral genome copies per ml of patient serum and then (2) administering to the patient the drug therapy of the subject method for a time period of about 20 weeks to about 50 weeks, or about 24 weeks to about 48 weeks, or about 30 weeks to about 40 weeks, or up to about 20 weeks, or up to about 24 weeks, or up to about 30 weeks, or up to about 36 weeks, or up to about 48 weeks.

In another embodiment, the invention provides any of the above-described methods for the treatment of an HCV infection, where the subject method is modified to include the steps of (1) identifying a patient having an HCV genotype 1 infection and an initial viral load of less than or equal to 2 million viral genome copies per ml of patient serum and then (2) administering to the patient the drug therapy of the subject method for a time period of about 20 weeks to about 24 weeks.

In another embodiment, the invention provides any of the above-described methods for the treatment of an HCV infection, where the subject method is modified to include the steps of (1) identifying a patient having an HCV genotype 1 infection and an initial viral load of less than or equal to 2 million viral genome copies per ml of patient serum and then (2) administering to the patient the drug therapy of the subject method for a time period of about 24 weeks to about 48 weeks.

In another embodiment, the invention provides any of the above-described methods for the treatment of an HCV infection, where the subject method is modified to include the steps of (1) identifying a patient having an HCV genotype 2 or 3 infection and then (2) administering to the patient the drug therapy of the subject method for a time period of about 24 weeks to about 60 weeks, or about 30 weeks to about one year, or about 36 weeks to about 50 weeks, or about 40 weeks to about 48 weeks, or at least about 24 weeks, or at least about 30 weeks, or at least about 36 weeks, or at least about 40 weeks, or at least about 48 weeks, or at least about 60 weeks.

In another embodiment, the invention provides any of the above-described methods for the treatment of an HCV infection, where the subject method is modified to include the steps of (1) identifying a patient having an HCV genotype 2 or 3 infection and then (2) administering to the patient the drug therapy of the subject method for a time period of about 20 weeks to about 50 weeks, or about 24 weeks to about 48 weeks, or about 30 weeks to about 40 weeks, or up to about 20 weeks, or up to about 24 weeks, or up to about 30 weeks, or up to about 36 weeks, or up to about 48 weeks.

In another embodiment, the invention provides any of the above-described methods for the treatment of an HCV infection, where the subject method is modified to include the steps of (1) identifying a patient having an HCV genotype 2 or 3 infection and then (2) administering to the patient the drug therapy of the subject method for a time period of about 20 weeks to about 24 weeks.

In another embodiment, the invention provides any of the above-described methods for the treatment of an HCV infection, where the subject method is modified to include the steps of (1) identifying a patient having an HCV genotype 2 or 3 infection and then (2) administering to the patient the drug therapy of the subject method for a time period of at least about 24 weeks.

In another embodiment, the invention provides any of the above-described methods for the treatment of an HCV infection, where the subject method is modified to include the steps of (1) identifying a patient having an HCV genotype 1 or 4 infection and then (2) administering to the patient the drug therapy of the subject method for a time period of about 24 weeks to about 60 weeks, or about 30 weeks to about one year, or about 36 weeks to about 50 weeks, or about 40 weeks to about 48 weeks, or at least about 24 weeks, or at least about 30 weeks, or at least about 36 weeks, or at least about 40 weeks, or at least about 48 weeks, or at least about 60 weeks.

In another embodiment, the invention provides any of the above-described methods for the treatment of an HCV infection, where the subject method is modified to include the steps of (1) identifying a patient having an HCV infection characterized by any of HCV genotypes 5, 6, 7, 8 and 9 and then (2) administering to the patient the drug therapy of the subject method for a time period of about 20 weeks to about 50 weeks.

In another embodiment, the invention provides any of the above-described methods for the treatment of an HCV infection, where the subject method is modified to include the steps of (1) identifying a patient having an HCV infection characterized by any of HCV genotypes 5, 6, 7, 8 and 9 and then (2) administering to the patient the drug therapy of the subject method for a time period of at least about 24 weeks and up to about 48 weeks.

Type II Interferon Receptor Agonists

As used herein, the term "Type II interferon receptor agonist" includes any naturally occurring or non-naturally-occurring ligand of a human Type II interferon receptor that binds to and causes signal transduction via the receptor. Type II interferon receptor agonists include interferons, including naturally-occurring interferons, modified interferons, synthetic interferons, pegylated interferons, fusion proteins comprising an interferon and a heterologous protein, shuffled interferons; antibody specific for an interferon receptor; non-peptide chemical agonists; and the like.

A specific example of a Type II interferon receptor agonist is IFN-gamma and variants thereof. While the present invention exemplifies use of an IFN-gamma polypeptide, it will be readily apparent that any Type II interferon receptor agonist can be used in a subject method.

SAPK Inhibitors

SAPK inhibitors suitable for use in a subject treatment method specifically include pirfenidone and pirfenidone analogs; and also specifically include any compound of Formula I as set forth in U.S. Patent Publication No. 20030149041.

Additional SAPK inhibitors suitable for use herein include agents that inhibit enzymatic activity of a SAPK by at least about 10%, at least about 20%, at least about 25%, at least about 30%, at least about 35%, at least about 40%, at least about 50%, at least about 60%, at least about 70%, at least about 80%, or at least about 90%, or more, when compared with the enzymatic activity of the SAPK in the absence of the SAPK inhibitor.

The signal transduction pathways that use mitogen-activated protein kinases (MAPK) have an important role in a variety of cellular responses, including growth, stress-induced gene expression, and compensation for alterations in the environment. The SAPK group of MAPKs includes the c-Jun N-terminal Kinase (JNK) and p38 kinases. The p38 group of MAPK include at least four members, designated p38 or p38α, p38β, p38γ, and p38δ. The amino acid sequences of p38α, p38β, and p38γ from various species are known. For example, the amino acid sequences of human p38α, p38α, and p38γ are found under the following GenBank Accession Nos.: 1) Q16539, NP_620583, and NP_001306 provide amino acid sequences of human p38α polypeptides; 2) NP_620478, NP_002742, and Q15759 provide amino acid sequences of human p38β polypeptides; and 3) NP_002960, P53778, and JC5252 provide amino acid sequences of human p38γ polypeptides.

In some embodiments, a suitable SAPK inhibitor is an agent that inhibits enzymatic activity of p38α, p38β, and p38γ. In other embodiments, a suitable SAPK inhibitor is an agent that preferentially inhibits the enzymatic activity of p38α and p38β, i.e., the agent is a stronger inhibitor of the enzymatic activity of p38α and p38β than that of p38γ, e.g., the agent's IC50 against p38α and p38β is at least about two-fold lower, or about five-fold lower, or about ten-fold lower, or more, below the agent's IC50 against p38γ.

In other embodiments, a suitable SAPK inhibitor is an agent that preferentially inhibits p38γ, i.e., the agent is a stronger inhibitor of the enzymatic activity of p38γ than that of p38α and p38β, e.g., the agent's IC50 against p38γ is at least about two-fold lower, or about five-fold lower, or about ten-fold lower, or more, below the agent's IC50 against p38α and p38β.

In some embodiments, a SAPK inhibitor is a competitive inhibitor of a SAPK, e.g., a p38α, a p38β, or a p38γ. In some of these embodiments, a SAPK inhibitor is one that competes for adenosine triphosphate (ATP) for binding to the ATP binding site of p38α, p38β, or p38γ.

In addition, stress-activated protein kinase (SAPK) inhibitors that are suitable for use in a subject combination therapy include any 2-alkyl imidazole as disclosed in U.S. Pat. No. 6,548,520; any of the 1,4,5-substituted imidazole compounds disclosed in U.S. Pat. Nos. 6,489,325; 1,4,5-substituted imidazole compounds disclosed in U.S. Pat. No. 6,569,871; heteroaryl aminophenyl ketone compounds disclosed in Published U.S. Patent Application No. 2003/0073832; pyridyl imidazole compounds disclosed in U.S. Pat. No. 6,288,089; and heteroaryl aminobenzophenones disclosed in U.S. Pat. No. 6,432,962. Also suitable for use are compounds disclosed in U.S. Pat. No. 6,214,854. Also suitable for use are the heterocyclic compounds discussed in WO 102/61426.

Pirfenidone and pirfenidone analogs, which are specifically included, are described in detail below. As discussed above, compounds of Formula I of U.S. Patent Publication No. 20030149041 are specifically included. Formula I is as follows:

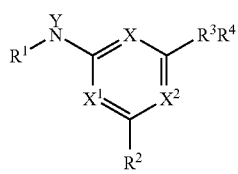

Formula I wherein: R¹ is chosen from —H, $C_1$ to $C_{20}$ hydrocarbon, aminocarbonylalkyl, alkoxyalkyl, substituted arylalkyl, heteroaryl, heteroarylalkyl, heterocyclylalkyl, and substituted heterocyclylalkyl;

R² is chosen from halogen, $C_1$ to $C_{20}$ hydrocarbon, hydroxy, heteroaryl, substituted heteroaryl, heterocyclyl, substituted heterocyclyl;

R⁵ is chosen from —H, alkyl and substituted alkyl;

R⁶ is chosen from a direct bond, alkyl, aryl, substituted aryl and heteroaryl;

R⁷ is chosen from —H, acyl, alkyl, substituted alkyl, alkoxycarbonyl, amidine, aryl, arylalkyl, heterocyclyl, heteroaryl, substituted heteroaryl, substituted aryloxy, heteroarylsulfonamido, dialkylsulfonamido,

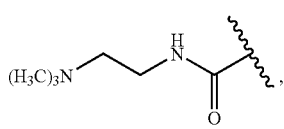

—C(O)NR⁸R⁹, —C(NH)NR⁸R⁹ and —NR⁸R⁹;

R⁸ is chosen from —H and alkyl;

R⁹ is chosen from —H, alkyl, substituted alkyl, aryl, heteroaryl, alkylcarbonyl and arylcarbonyl;

R³ is chosen from a direct bond,

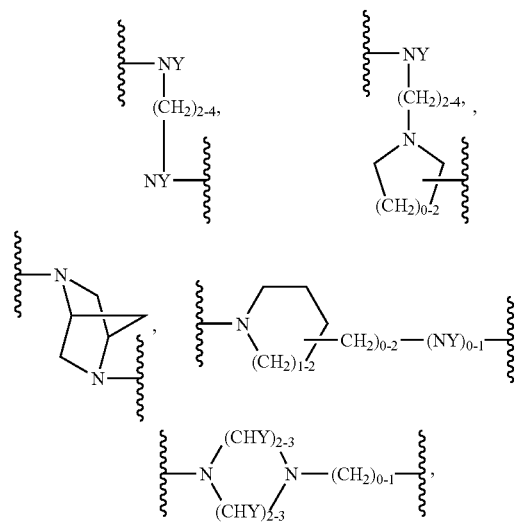

wherein the left hand bond is the point of attachment to the ring and the right band bond is the point of attachment to R⁴;

R⁴ is chosen from —H, halogen, alkyl, heterocyclyl, alkylamino, aminocarbonyl,

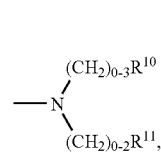

—C(S)NHR¹², —CHR¹³R¹⁴, —C(O)NHR¹⁵, —C(O)(CH₂)₀₋₂R¹⁶, —S(O₂)R¹⁷, —OR¹⁸

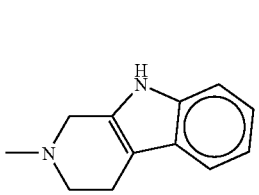 and 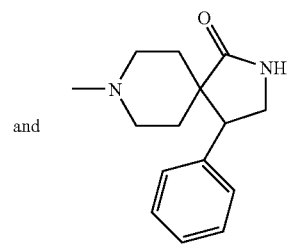

wherein R¹⁰ is chosen from —H, —OH, alkyl, cycloalkyl and substituted cycloalkyl; R¹¹ is chosen from —H; —OH, —COOH, aryl, substituted aryl, heteroaryl, substituted heteroaryl, aryl substituted alkyl, cycloalkyl, substituted cycloalkyl, alkoxy, aminocarbonyl, aminocarbonylalkyl,

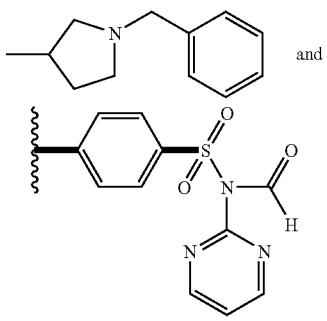 and

R¹² is chosen from alkyl and aryl; R¹³ is chosen from —H and aryl; R¹⁴ is chosen from aryl, substituted aryl, heteroaryl, substituted alkyl, aryl substituted alkyl and alkoxy substituted alkyl; R¹⁵ is chosen from alkyl, aryl, substituted aryl and substituted alkyl; R¹⁶ is chosen from aryl, substituted aryl, heteroaryl, carboxyl, alkoxy, substituted alkyl, cycloalkyl, substituted cycloalkyl, aminocarbonyl, substituted aminocarbonyl, heterocyclyl and

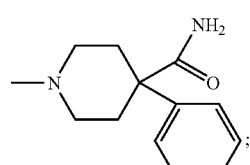;

R¹⁷ is chosen from alkyl and dialkylamino; R¹⁸ is chosen from $C_1$ to $C_{20}$ hydrocarbon, substituted $C_1$ to $C_{20}$ hydrocarbon and heteroaryl; Y is chosen from —H and lower alkyl, or Y and R¹ taken together with the attached N, may be chosen from heterocyclyl, substituted heterocyclyl, heteroaryl and substituted heteroaryl; wherein at least two of X, X¹ and X² are —N═, and the other is chosen from —C(H)═ and —N═.

Of particular interest in some embodiments is use of any of the following SAPK inhibitor compounds, or pharmaceutically acceptable salts, or derivatives, or esters, or analogs, thereof:

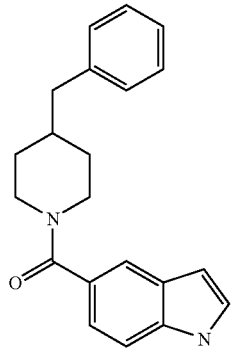

which compound has the IUPAC designation (4-benzyl-piperidin-1-yl)-(1H-indol-5-yl)-methanone. Also suitable for use are any of the following compounds: (4-benzyl-piperidin-1-yl)-(6-chloro-1H-indol-5-yl)-methanone; (4-chloro-1H-indol-5-yl)-[4-(4-fluoro-benzyl)-piperidin-1-yl]-methanone; (4-benzyl-piperidin-1-yl)-(4-methoxy-1H-inol-5-yl)-methanone; (4-Benzyl-piperidin-1-yl)-{1-[3-(cyclohexylmethyl-amino)-2-hydroxy-propyl]-1H-indol-5-yl}-methanone; (4-Benzyl-piperidin-1-yl)-{1-[2-hydroxy-3-(4-methyl-piperazin-1-yl)-propyl]-1H-indol-5-yl}-methanone; [1-(3-Benzylamino-2-hydroxy-propyl)-1H-indol-5-yl]-(4-benzyl-piperidin-1-yl)-methanone; (4-Benzyl-piperidin-1-yl)-{1-[2-hydroxy-3-(4-methoxy-benzylamino)-propyl]-1H-indol-5-yl}methanone; (4-Benzyl-piperidin-1-yl)-[1-(2-hydroxy-3-propylamino-propyl)-1H-indol-5-yl]-methanone; (4-Benzyl-piperidin-1-yl)-[1-(pyridine-4-carbonyl)-1H-indol-5-yl]-methanone; 1-[5-(4-Benzyl-piperidine-1-carbonyl)-indol-1-yl]-ethanone; 2-[5-(4-Benzyl-piperidine-1-carbonyl)-indol-1-yl]-N-(4-methoxy-benzyl)-acetamide; 5-(4-Benzyl-piperidine-1-carbonyl)-1H-indole-3-carboxylic acid (2-methoxy-ethyl)-amide; 5-(4-Benzyl-piperidine-1-carbonyl)-1H-indole-3-carboxylic acid (2-methylamino-ethyl)-amide; 5-(4-Benzyl-piperidine-1-carbonyl)-1H-indole-3-carboxylic acid (2-amino-ethyl)-amide; [3-(4-Benzyl-piperidine-1-carbonyl)-1H-indol-5-yl]-(4-benzyl-piperidin-1-yl)-methanone; [3-(4-Benzyl-piperidine-1-carbonyl)-1H-indol-6-yl]-(4-benzyl-piperidin-1-yl)-methanone; 5-(4-Benzyl-piperidine-1-carbonyl)-1H-indole-3-carboxylic acid 4-fluoro-benzylamide; 5-(4-Benzyl-piperidine-1-carbonyl)-1H-indole-3-carboxylicacid[2-(3,5-dimethoxy-phenyl)-ethyl]-amide; (4-Benzyl-piperidin-1-yl)-(6-methoxy-1H-indol-5-yl)-methanone; 1-[5-(4-Benzyl-piperidine-1-carbonyl)-1H-indol-3-yl]-2,2,2-trifluoro-ethanone; 5-(4-Benzyl-piperidine-1-carbonyl)-6-methoxy-1H-indole-3-carboxylic acid (2-dimethylamino-ethyl)-amide; 5-(4-Benzyl-piperidine-1-carbonyl)-1H-indole-3-carboxylic acid; 5-(4-Benzyl-piperidine-1-carbonyl)-1H-indole-3-carboxylic acid (2-dimethylamino-ethyl)-amide; (1H-Benzoimidazol-5-yl)-(4-benzyl-piperidin-1-yl)-methanone; (1H-Benzoimidazol-5-yl)-[4-(4-fluoro-benzyl)-piperidin-1-yl]-methanone; (4-Benzyl-piperidin-1-yl)-(3-morpholin-4-ylmethyl-1H-indol-5-yl)-methanone; 1-[6-(4-Benzyl-piperidine-1-carbonyl)-1H-indol-3-yl]-2,2,2-trifluoro-ethanone; (4-Benzyl-piperidin-1-yl)-[1-(pyridine-4-carbonyl)-1H-indol-6-yl]-methanone; (3-Benzyl-8-aza-bicyclo[3.2.1]oct-8-yl)-(6-methoxy-1H-indol-5-yl)-methanone; (3H-Benzoimidazol-5-yl)-(3-benzyl-8-aza-bicyclo[3.2.1]oct-8-yl)-methanone; [3-(4-Fluoro-benzyl)-pyrrolidin-1-yl]-(1H-indol-6-yl)-methanone; (1H-Benzoimidazol-5-yl)-[4-(2,6-difluoro-benzyl)-piperazin-1-yl]-methanone; (1H-Benzoimidazol-5-yl)-[4-(4-methylsulfanyl-benzyl)-piperazin-1-yl]-methanone; (1H-Benzoimidazol-5-yl)-[4-(2,3-difluoro-benzyl)-piperazin-1-yl]-methanone; (1H-Benzoimidazol-5-yl)-[4-(3,5-difluoro-benzyl)-piperazin-1-yl]-methanone; (1H-Benzoimidazol-5-yl)-[4-(3-chloro-benzyl)-piperazin-1-yl]-methanone; 4-[4-(1H-Benzoimidazole-5-carbonyl)-piperazin-1-ylmethyl]-benzoic acid methyl ester; (1H-Benzoimidazol-5-yl)-[4-(4-methoxy-benzyl)-piperazin-1-yl]-methanone; (1H-Benzoimidazol-5-yl)-[4-(4-trifluoromethoxy-benzyl)-piperazin-1-yl]-methanone; (1H-Benzoimidazol-5-yl)-[4-(4-methyl-benzyl)-piperazin-1-yl]-methanone; (1H-Benzoimidazol-5-yl)-[4-(2,4-dichloro-benzoyl)-piperazin-1-yl]-methanone; (1H-Benzoimidazol-5-yl)-[4-(3,4-dichloro-benzoyl)-piperazin-1-yl]-methanone; trans-1-[4-(1H-Benzoimidazole-5-carbonyl)-piperazin-1-yl]-3-(3-trifluoromethyl-phenyl)-propenone; (1H-Benzoimidazol-5-yl)-[4-(4-chloro-benzoyl)-piperazin-1-yl]-methanone; (1H-Benzoimidazol-5-yl)-(4-benzoyl-piperazin-1-yl)-methanone; (1H-Benzoimidazol-5-yl)-[4-(2-trifluoromethyl-benzoyl)-piperazin-1-yl]-methanone; (1H-Benzoimidazol-5-yl)-[4-(4-methoxy-benzoyl)-piperazin-1-yl]-methanone; (1H-Benzoimidazol-5-yl)-[4-(3,4-dichloro-phenyl)-piperazin-1-yl]-methanone; (1H-Benzoimidazol-5-yl)-{4-[(4-chloro-phenyl)-phenyl-methyl]-piperazin-1-yl}-methanone; trans-(1H-Benzoimidazol-5-yl)-[4-(3-phenyl-allyl)-piperazin-1-yl]-methanone; (1H-Benzoimidazol-5-yl)-{4-[bis-(4-fluoro-phenyl)-methyl]-piperazin-1-yl}-methanone; (1H-Benzoimidazol-5-yl)-[4-(4-chloro-benzyl)-piperazin-1-yl]-methanone; (1H-Benzoimidazol-5-yl)-[4-(2-chloro-benzyl)-piperazin-1-yl]-methanone; (1H-Benzoimidazol-5-yl)-[4-(3,4,5-trimethoxy-benzyl)-piperazin-1-yl]-methanone; (1H-Benzoimidazol-5-yl)-[4-(4-diethylamino-benzyl-piperazin-1-yl]-methanone; (1H-Benzoimidazol-5-yl)-(4-biphenyl-4-ylmethyl-piperazin-1-yl)-methanone; (1H-Benzoimidazol-5-yl)-[4-(4-phenoxy-benzyl)-piperazin-1-yl]-methanone; (4-Benzyl-piperidin-1-yl)-(6-methoxy-1H-benzoimidazol-5-yl)-methanone; (4-Benzyl-piperidin-1-yl)-(1-isopropyl-1H-benzoimidazol-5-yl)-methanone; (4-Benzyl-piperidin-1-yl)-(3-isopropyl-3H-benzoimidazol-5-yl)-methanone; (4-Benzyl-piperidin-1-yl)-(1-isopropyl-1H-indol-5-yl)-methanone; [4-(4-Chloro-benzyl)-piperazin-1-yl]-(1-isopropyl-1H-indol-5-yl)-methanone; (1H-Benzotriazol-5-yl)-(4-benzyl-piperidin-1-yl)-methanone; (4-Benzyl-piperidin-1-yl)-(1-isopropyl-1H-benzotriazol-5-yl)-methanone; [4-(4-Chloro-benzyl)-piperidin-1-yl]-(1H-indol-5-yl)-methanone; [4-(3-Chloro-benzyl)-piperidin-1-yl]-(1H-indol-5-yl)-methanone; [4-(2-Chloro-benzyl)-piperidin-1-yl]-(1H-indol-5-yl)-methanone; (4-Benzyl-2-methyl-piperidin-1-yl)-(1H-indol-5-yl)-methanone; (4-Benzyl-piperidin-1-yl)-(4-chloro-1H-indol-5-yl)-methanone; (4-Benzyl-piperidin-1-yl)-[7-chloro-1-(pyridine-3-carbonyl)-1H-indol-6-yl]-methanone; (4-Benzyl-piperidin-1-yl)-(5-chloro-1H-indol-6-yl)-methanone; (4-Benzyl-piperidin-1-yl)-(7-chloro-1H-indol-6-yl)-methanone; 6-(4-Benzyl-piperidine-1-carbonyl)-7-chloro-1-(pyridine-3-carbonyl)-1H-indole-3-carboxylic acid (2-dimethylamino-ethyl)-amide; (4-Benzyl-piperidin-1-yl)-(1-pyridin-4-ylmethyl-1H-indol-5-yl)-methanone; (4-Benzyl-piperidin-1-yl)-[6-methoxy-1-(pyridine-3-carbonyl)-1H- indol-5-yl]-methanone; [5-(4Benzyl-piperidine-1-carbonyl)-indol-1-yl]-acetic acid methyl ester; 1-[5-(4-Benzyl-piperidine-1-carbonyl)-indol-1-yl]-3-isopropylamino-propan-1-one; 1-[5-(4-Benzyl-piperidine-1-carbonyl)-indol-1-yl]-3-piperazin-1-yl-propan-1-one; 3-Benzylamino-1-[5-(4-benzyl-piperidine-1-carbonyl)-indol-1-yl]-propan-1-one; 1-[5-(4-Benzyl-piperidine-1-carbonyl)-indol-1-yl]-3-morpholin-(4-yl-propan-1-one; 2-[5-(4-Benzyl-piperidine-1-carbonyl)-indol-1-yl]-N-propyl-acetamide; (4-Benzyl-piperidin-1-yl)-[1-(2-diethylamino-ethyl)-6-methoxy-1H-indol-5-yl]-methanone; (4-Benzyl-piperidin-1-yl)-[1-(3-diethylamino-propyl)-1H-indol-5-yl]-methanone; (4-Benzyl-piperidin-1-yl)-[1-(2-diethylamino-ethyl)-1H-indol-5-yl]-methanone; (4-Benzyl-piperidin-1-yl)-[6-chloro-1-(3-diethylamino-propyl)-1H-indol-5-yl]-methanone; [1-(2-Diethylamino-ethyl)-1H-indol-5-yl]-[4-(4-fluoro-benzyl)-piperidin-1-yl]-methanone; (4-Benzyl-piperidin-1-yl)-[1-(3-diethylamino-propyl)-6-methoxy-1H-indol-5-yl]-methanone; 5-(4-Benzyl-piperidine-1-carbonyl)-1H-indole-3-carboxylic acid (2-amino-ethyl)-methyl-amide; 5-(4-Benzyl-piperidine-1-carbonyl)-1H-indole-3-carboxylic acid [2-(3,4-dimethoxy-phenyl)-ethyl]-amide; (4-Benzyl-piperidin-1-yl)-(3-diethylaminomethyl-1H-indol-5-yl)-methanone; [4-(4-Fluoro-benzyl)-piperidin-1-yl]-(6-methoxy-1H-indol-5-yl)-methanone; (4-Benzyl-piperidin-1-yl)-(1-pyridin-4-yl-1H-indol-5-yl)-methanone; and 4-(4-Benzyl-piperidin-1-yl)-(4-chloro-2-methyl-1H-indol-5-yl)-methanone; or pharmaceutically acceptable salts, or derivatives, or esters, or analogs, of any of the foregoing compounds.

Of particular interest in some embodiments is use of any of the following SAPK inhibitor compounds, or pharmaceutically acceptable salts, or derivatives, or esters, or analogs, thereof:

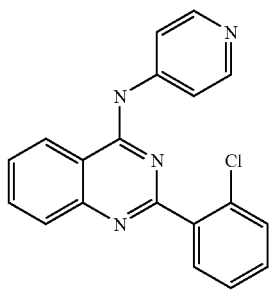

which compound has the IUPAC designation [2-(2-Chloro-phenyl)-quinazolin-4-yl]-pyridin-4-yl-amine. Also suitable for use are any of the following compounds: [2-(2,6-Dichloro-phenyl)-quinazolin-4-yl]-pyridin-4-yl-amine; Pyridin-4-yl-(2-o-tolyl-quinazolin-4-yl)-amine; [2-(2-Bromo-phenyl)-quinazolin-4-yl]-pyridin-4-yl-amine; [2-(2-Fluoro-phenyl)-quinazolin-4-yl]-pyridin-4-yl-amine; [2-(2,6-Difluoro-phenyl)-quinazolin-4-yl]-pyridin-4-yl-amine; (2-Phenyl-quinazolin-4-yl)-pyridin-4-yl-amine; [2-(4-Fluoro-phenyl)-quinazolin-4-yl]-pyridin-4-yl-amine; [2-(4-Methoxy-phenyl)-quinazolin-4-yl]-pyridin-4-yl-amine; [2-(3-Fluoro-phenyl)-quinazolin-4-yl]-pyridin-4-yl-amine; Isopropyl-(2-phenyl-quinazolin-4-yl)-pyridin-4-yl-amine; (4-Methoxy-benzyl)-(2-phenyl-quinazolin-4-yl)-pyridin-4-yl-amine; (2-Phenyl-quinazolin-4-yl)-pyridin-4-ylmethyl-amine; [2-(4-Chloro-phenyl)-quinazolin-4-yl]-pyridin-4-yl-methyl-amine; (2-Phenyl-quinazolin-4-yl)-pyridin-3-yl-amine; (2-Phenyl-quinazolin-4-yl)-pyridin-2-ylmethyl-amine; (2-Phenyl-quinazolin-4-yl)-pyridin-3-ylmethyl-amine; (2-Phenyl-quinazolin-4-yl)-(2-pyridin-2-yl-ethyl)-amine; (2-Phenyl-quinazolin-4-yl)-pyrimidin-4-yl-amine; (2-Phenyl-quinazolin-4-yl)-pyrimidin-2-yl-amine; Phenyl-(2-phenyl-quinazolin-4-yl)-amine; Benzyl-[2-(3-chloro-phenyl)-quinazolin-4-yl]-amine; 3-(2-Phenyl-quinazolin-4-ylamino)-phenol; 2-(2-Phenyl-quinazolin-4-ylamino)-phenol; 4-(2-Phenyl-quinazolin-4-ylamino)-phenol; (1H-Indol-4-yl)-(2-phenyl-quinazolin-4-yl)-amine; (1H-Indol-5-yl)-(2-phenyl-quinazolin-4-yl)-amine; (4-Methoxy-phenyl)-(2-phenyl-quinazolin-4-yl)-amine; (3-Methoxy-phenyl)-(2-phenyl-quinazolin-4-yl)-amine; (2-Methoxy-phenyl)-(2-phenyl-quinazolin-4-yl)-amine; 2-[4-(2-Phenyl-quinazolin-4-ylamino)-phenyl]-ethanol; 3-(2-Phenyl-quinazolin-4-ylamino)-benzonitrile; (2,5-Difluoro-benzyl)-(2-phenyl-quinazolin-4-yl)-amine; [4-(2-Butyl)-phenyl]-(2-phenyl-quinazolin-4-yl)-amine; N,N-Dimethyl-N'-(2-phenyl-quinazolin-4-yl)-benzene-1,4-diamine; [2-(2-Chloro-phenyl)-6,7-dimethoxy-quinazolin-4-yl]-pyridin-4-yl-amine; [2-(2-Fluoro-phenyl)-6-nitro-quinazolin-4-yl]-pyridin-4-yl-amine; 2-(2-Fluoro-phenyl)-N-4-pyridin-4-yl-quinazoline-4,6-diamine; 2-(2-Fluoro-phenyl)-N-4-pyridin-4-yl-quinazoline-4,7-diamine; 2-(2-Fluoro-phenyl)-N-6-(3-methoxy-benzyl)-N-4-pyridin-4-yl-quinazoline-4,6-diamine; 2-(2-Fluoro-phenyl)-N-6-(4-methoxy-benzyl)-N-4-pyridin-4-yl-quinazoline-4,6-diamine; N6-Isobutyl-2-(2-fluoro-phenyl)-N-4-pyridin-4-yl-quinazoline-4,6-diamine; 2-(2-Fluoro-phenyl)-N-6-(4-methylsulfanyl-benzyl)-N-4-pyridin-4-yl-quinazoline-4,6-diamine; 4-(4-Pyridylamino)-2-(4-chlorophenyl)quinazoline; 2-Phenyl-4-(2-pyridylamino)-quinazoline; and [2-(2-Fluoro-phenyl)-pyrido[2,3-d]pyrimidin-4-yl]-pyridin-4-yl-amine; or pharmaceutically acceptable salts, or derivatives, or esters, or analogs, of any of the foregoing compounds.

A further suitable SAPK inhibitor is BIRB796 (1-(5-tert-butyl-2-p-tolyl-2H-pyrazol-3-yl)-3-[4-(2-morpholin-4-yl-ethoxy)-naphthalen-1-yl]-urea); see U.S. Pat. No. 6,319,921.

BIRB796 has the following structure:

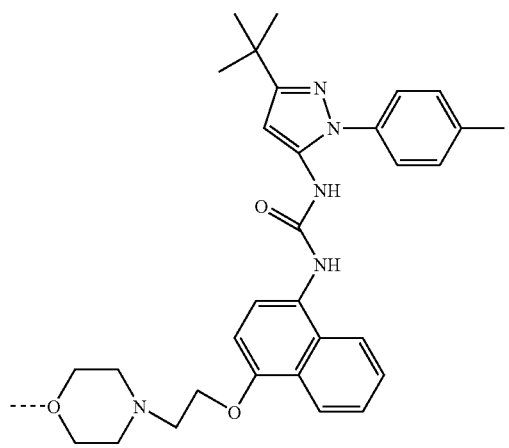

Also suitable for use are pharmaceutically active derivatives, analogs, esters, and salts of BIRB796.

Another suitable SAPK inhibitor is 2(1H)-quinazolinone, as shown below:

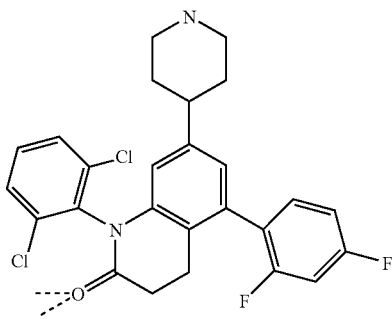

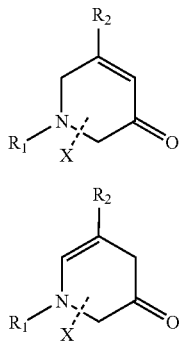

Also suitable for use are pharmaceutically active derivatives, analogs, esters, and salts of 2(1H)-quinazolinone.

Additionally suitable for use is VX-745 (Vertex Pharmaceuticals and Kissei Pharmaceutical Co.) VX-745 has been reported to inhibit several isotypes of p38, including p38-alpha, p38-beta and p38-gamma.

Pirfenidone and Analogs Thereof

Pirfenidone (5-methyl-1-phenyl-2-(1H)-pyridone) and specific pirfenidone analogs can be used to enhance the methods of treatment for HCV infection disclosed herein.

Pirfenidone

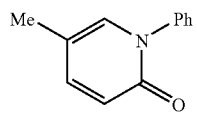

Pirfenidone Analogs

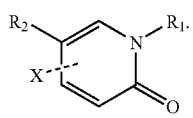

I

Descriptions for Substituents $R_1$, $R_2$, X $R_1$: carbocyclic (saturated and unsaturated), heterocyclic (saturated or unsaturated), alkyls (saturated and unsaturated). Examples include phenyl, benzyl, pyrimidyl, naphthyl, indolyl, pyrrolyl, furyl, thienyl, imidazolyl, cyclohexyl, piperidyl, pyrrolidyl, morpholinyl, cyclohexenyl, butadienyl, and the like.

$R_1$ can further include substitutions on the carbocyclic or heterocyclic moieties with substituents such as halogen, nitro, amino, hydroxyl, alkoxy, carboxyl, cyano, thio, alkyl, aryl, heteroalkyl, heteroaryl and combinations thereof, for example, 4-nitrophenyl, 3-chlorophenyl, 2,5-dinitrophenyl, 4-methoxyphenyl, 5-methyl-pyrrolyl, 2,5-dichlorocyclohexyl, guanidinyl-cyclohexenyl and the like.

$R_2$: alkyl, carbocyclic, aryl, heterocyclic, hydroxyl, alkoxy, carboxyl. Examples include: methyl, ethyl, propyl, isopropyl, phenyl, 4-nitrophenyl, thienyl, hydroxyl, methoxy, carboxy and the like.

X: may be any number (from 1 to 3) of substituents on the carbocyclic or heterocyclic ring. The substituents can be the same or different. Substituents can include hydrogen, alkyl, heteroalkyl, aryl, heteroaryl, halo, nitro, carboxyl, hydroxyl, cyano, amino, thio, alkylamino, haloaryl and the like.

The substituents may be optionally further substituted with 1-3 substituents from the group consisting of alkyl, aryl, nitro, alkoxy, hydroxyl and halo groups. Examples include: methyl, 2,3-dimethyl, phenyl, p-tolyl, 4-chlorophenyl, 4-nitrophenyl, 2,5-dichlorophenyl, furyl, thienyl and the like.

Specific Examples include those shown in Table 10:

TABLE 10

| IA | IIB |
|---|---|
| 5-Methyl-1-(2'-pyridyl)-2-(1H) pyridine, | 6-Methyl-1-phenyl-3-(1H) pyridone, |
| 6-Methyl-1-phenyl-2-(1H) pyridone, | 5-Methyl-1-p-tolyl-3-(1H) pyridone, |
| 5-Methyl-3-phenyl-1-(2'-thienyl)-2-(1H) pyridone, | 5-Methyl-1-(2'-naphthyl)-3-(1H) pyridone, |
| 5-Methyl-1-(2'-naphthyl)-2-(1H) pyridone, | 5-Methyl-1-phenyl-3-(1H) pyridone, |
| 5-Methyl-1-p-tolyl-2-(1H) pyridone, | 5-Methyl-1-(5'-quinolyl)-3-(1H) pyridone, |
| 5-Methyl-1-(1'naphthyl)-2-(1H) pyridone, | 5-Ethyl-1-phenyl-3-(1H) pyridone, |
| 5-Ethyl-1-phenyl-2-(1H) pyridone, | 5-Methyl-1-(4'-methoxyphenyl)-3-(1H) pyridone, |
| 5-Methyl-1-(5'-quinolyl)-2-(1H) pyridone, | 4-Methyl-1-phenyl-3-(1H) pyridone, |
| 5-Methyl-1-(4'-quinolyl)-2-(1H) pyridone, | 5-Methyl-1-(3'-pyridyl)-3-(1H) pyridone, |
| 5-Methyl-1-(4'-pyridyl)-2-(1H) pyridone, | 5-Methyl-1-(2'-Thienyl)-3-(1H) pyridone, |
| 3-Methyl-1-phenyl-2-(1H) pyridone, | 5-Methyl-1-(2'-pyridyl)-3-(1H) pyridone, |
| 5-Methyl-1-(4'-methoxyphenyl)-2-(1H) pyridone, | 5-Methyl-1-(2'-quinolyl)-3-(1H) pyridone, |

TABLE 10-continued

| IA | IIB |
|---|---|
| 1-Phenyl-2-(1H) pyridone,<br>1,3-Diphenyl-2-(1H) pyridone,<br>1,3-Diphenyl-5-methyl-2-(1H) pyridone,<br>5-Methyl-1-(3'-trifluoromethylphenyl)-2-(1H)-pyridone,<br>3-Ethyl-1-phenyl-2-(1H) pyridone,<br>5-Methyl-1-(3'-pyridyl)-2-(1H) pyridone,<br>5-Methyl-1-(3-nitrophenyl)-2-(1H) pyridone,<br>3-(4'-Chlorophenyl)-5-Methyl-1-phenyl-2-(1H) pyridone,<br>5-Methyl-1-(2'-Thienyl)-2-(1H) pyridone,<br>5-Methyl-1-(2'-thiazolyl)-2-(1H) pyridone,<br>3,6-Dimethyl-1-phenyl-2-(1H) pyridone,<br>1-(4'Chlorophenyl)-5-Methyl-2-(1H) pyridone,<br>1-(2'-Imidazolyl)-5-Methyl-2-(1H) pyridone,<br>1-(4'-Nitrophenyl)-2-(1H) pyridone,<br>1-(2'-Furyl)-5-Methyl-2-(1H) pyridone,<br>1-Phenyl-3-(4'-chlorophenyl)-2-(1H) pyridine. | 1-Phenyl-3-(1H) pyridine,<br>1-(2'-Furyl)-5-methyl-3-(1H) pyridone,<br>1-(4'-Chlorophenyl)-5-methyl-3-(1H) pyridine. |

U.S. Pat. Nos. 3,974,281; 3,839,346; 4,042,6102; 4,052,509; 5,310,562; 5,518,729; 5,716,632; and 6,090,822 describe methods for the synthesis and formulation of pirfenidone and specific pirfenidone analogs in pharmaceutical compositions suitable for use in the methods of the present invention.

TNF Antagonists

Suitable TNF-α antagonists for use herein include agents that decrease the level of TNF-α synthesis, agents that block or inhibit the binding of TNF-α to a TNF-α receptor (TNFR), and agents that block or inhibit TNFR-mediated signal transduction. Unless otherwise expressly stated, every reference to a "TNF-α antagonist" or "TNF antagonist" herein will be understood to mean a TNF-α antagonist other than SAPK inhibitors (including pirfenidone and pirfenidone analogs).

As used herein, the terms "TNF receptor polypeptide" and "TNFR polypeptide" refer to polypeptides derived from TNFR (from any species) that are capable of binding TNF. Two distinct cell-surface TNFRs have described: Type II TNFR (or p75 TNFR or TNFR11) and Type I TNFR (or p55 TNFR or TNFR1). The mature full-length human p75 TNFR is a glycoprotein having a molecular weight of about 75-80 kilodaltons (kD). The mature full-length human p55 TNFR is a glycoprotein having a molecular weight of about 55-60 kD. Exemplary TNFR polypeptides are derived from TNFR Type I and/or TNFR type II. Soluble TNFR includes p75 TNFR polypeptide; fusions of p75 TNFR with heterologous fusion partners, e.g., the Fc portion of an immunoglobulin.

TNFR polypeptide may be an intact TNFR or a suitable fragment of TNFR. U.S. Pat. No. 5,605,690 provides examples of TNFR polypeptides, including soluble TNFR polypeptides, appropriate for use in the present invention. In many embodiments, the TNFR polypeptide comprises an extracellular domain of TNFR. In some embodiments, the TNFR polypeptide is a fusion polypeptide comprising an extracellular domain of TNFR linked to a constant domain of an immunoglobulin molecule. In other embodiments, the TNFR polypeptide is a fusion polypeptide comprising an extracellular domain of the p75 TNFR linked to a constant domain of an IgG1 molecule. In some embodiments, when administration to humans is contemplated, an Ig used for fusion proteins is human, e.g., human IgG1.

Monovalent and multivalent forms of TNFR polypeptides may be used in the present invention. Multivalent forms of TNFR polypeptides possess more than one TNF binding site. In some embodiments, the TNFR is a bivalent, or dimeric, form of TNFR. For example, as described in U.S. Pat. No. 5,605,690 and in Mohler et al., 11023, J. Immunol., 151: 1548-1561, a chimeric antibody polypeptide with TNFR extracellular domains substituted for the variable domains of either or both of the immunoglobulin heavy or light chains would provide a TNFR polypeptide for the present invention. Generally, when such a chimeric TNFR:antibody polypeptide is produced by cells, it forms a bivalent molecule through disulfide linkages between the immunoglobulin domains. Such a chimeric TNFR:antibody polypeptide is referred to as TNFR:Fc.

In one embodiment, a subject method involves administration of an effective amount of the soluble TNFR ENBREL® etanercept. ENBREL® is a dimeric fusion protein consisting of the extracellular ligand-binding portion of the human 75 kilodalton (p75) TNFR linked to the Fc portion of human IgG1. The Fc component of ENBREL® contains the CH2 domain, the CH3 domain and hinge region, but not the CH1 domain of IgG1. ENBREL® is produced in a Chinese hamster ovary (CHO) mammalian cell expression system. It consists of 934 amino acids and has an apparent molecular weight of approximately 150 kilodaltons. Smith et al. (11020) Science 248:1019-1023; Mohler et al. (11023) J. Immunol. 151: 1548-1561; U.S. Pat. No. 5,395,760; and U.S. Pat. No. 5,605,690.

Also suitable for use are monoclonal antibodies that bind TNF-α. Monoclonal antibodies include "humanized" mouse monoclonal antibodies; chimeric antibodies; monoclonal antibodies that are at least about 80%, at least about 90%, at least about 95%, or 100% human in amino acid sequence; and the like. See, e.g., WO 90/10077; WO 90/04036; and WO 92/02190. Suitable monoclonal antibodies include antibody fragments, such as Fv, F(ab')$_2$ and Fab; synthetic antibodies; artificial antibodies; phage display antibodies; and the like.

Examples of suitable monoclonal antibodies include infliximab (REMICADE®, Centocor); and adalimumab (HUMIRA™, Abbott) REMICADE® is a chimeric monoclonal anti-TNF-α antibody that includes about 25% mouse amino acid sequence and about 75% human amino acid sequence. REMICADE® comprises a variable region of a mouse monoclonal anti-TNF-α antibody fused to the constant region of a human IgG1. Elliott et al. (11023) *Arthritis Rheum.* 36:1681-1690; Elliott et al. (11024) *Lancet* 344: 1105-1110; Baert et al. (11029) *Gastroenterology* 116:22-28. HUMIRA™ is a human, full-length IgG1 monoclonal antibody that was identified using phage display technology. Piascik (2003) *J. Am. Pharm. Assoc.* 43:327-328.

Methods to assess TNF antagonist activity are known in the art and exemplified herein. For example, TNF antagonist activity may be assessed with a cell-based competitive binding assay. In such an assay, radiolabeled TNF is mixed with serially diluted TNF antagonist and cells expressing cell membrane bound TNFR. Portions of the suspension are centrifuged to separate free and bound TNF and the amount of radioactivity in the free and bound fractions determined. TNF antagonist activity is assessed by inhibition of TNF binding to the cells in the presence of the TNF antagonist.

As another example, TNF antagonists may be analyzed for the ability to neutralize TNF activity in vitro in a bioassay using cells susceptible to the cytotoxic activity of TNF as target cells. In such an assay, target cells, cultured with TNF, are treated with varying amounts of TNF antagonist and subsequently are examined for cytolysis. TNF antagonist activity is assessed by a decrease in TNF-induced target cell cytolysis in the presence of the TNF antagonist.

TGF-β Antagonists

TGF-β antagonists suitable for use in a subject treatment method include agents that decrease the level of TGF-β, synthesis, agents that block or inhibit the binding of TGF-β to a TGF-β receptor, and agents that block or inhibit TGF-β receptor-mediated signal transduction. As used herein, the term "TGF-β antagonist" refers to any agent that decreases the level of TGF-β synthesis, any agent that blocks or inhibits the binding of TGF-β to a TGF-β receptor, and any agent that blocks or inhibits TGF-β receptor-mediated signal transduction. Unless otherwise expressly stated, every reference to a "TGF-β antagonist" herein will be understood to mean a TGF-β antagonist other than SAPK inhibitors (including pirfenidone and pirfenidone analogs). As used herein, the term "TGF-β" includes any TGF-β subtype, including TGF-β1, TGF-β2, and TGF-β3. Suitable TGF-β antagonists include, but are not limited to, antibodies specific for TGF-β (including antibodies specific for a particular TGF-β subtype; and antibodies cross-reactive with two or more TGF-β subtypes); antibodies to TGF-β receptor; soluble TGF-β receptor; decorin; and agents that inhibit TGF-β signaling.

Suitable TGF-β antagonists include antibodies specific for TGF-β. Antibodies specific for TGF-β are known in the art. See, e.g., U.S. Pat. Nos. 5,783,185, 5,772,1028, 5,674,843, 5,571,714, 5,462,925, and 5,426,098; WO 97/13844; and U.S. Patent Publication Nos 20030064069 and 20030091566. Non-limiting examples of suitable anti-TGF-β antibodies include CAT-152 (lerdelibumab; Trabio™; Cambridge Antibody Technology), a human anti-TGF-β2 monoclonal antibody; CAT-192 (metelimumab; Cambridge Antibody Technology), a human anti-TGF-β1 monoclonal antibody; and GC-1008 (Genzyme Corp.), a pan-specific human monoclonal antibody to TGF-β1, TGF-β2, and TGF-β3.

Suitable TGF-β antagonists include soluble TGF-β receptors. Soluble TGF-β, receptors typically lack most or all of the transmembrane portion of a naturally-occurring TGF-β receptor, such that the protein is not membrane bound, yet retains TGF-β binding. Soluble TGF-β receptors include soluble fusion proteins comprising a portion of a TGF-β receptor fused in-frame to a heterologous (non-TGF-β receptor) protein (a "fusion partner"). Non-limiting examples of fusion partners are immunoglobulin Fc, poly-histidine, and the like. Soluble TGF-β receptors have been described in the art. See, e.g., Wang et al. (11029) *Thorax* 54:805-812; George et al. (11029) *Proc. Natl. Acad. Sci. USA* 96:12719-12724; Muraoka et al. (2002) *J. Clin. Invest.* 109:1551-1559; and Yata et al. (2002) *Hepatology* 35:1022-1030.

TGF-β antagonists include Gleevec™. Gleevec™ (also known as STI-571, or CGP57148B) has the chemical name 4-[(4-methyl-1-piperazinyl)methyl]-N-[4-methyl-3-[[4-(3-pyridinyl)-2-pyrimidinyl]amino-phenyl]benzamide methanesulfonate is commonly known as imatinib mesylate and sold under the trademark Gleevec™. Gleevec™ is a 2-phenylaminopyrimidine that targets the ATP-binding site of the kinase domain of Bcr-Abl tyrosine kinase (see, e.g. Druker et al. (11026) *Nature Med.* 2, 561; and Buchdunger et al. (11023) *Proc. Natl. Acad. Sci. USA* 92:2558-2562).

In certain embodiments, the agents are pyrimidine derivatives as described in U.S. Pat. No. 5,521,184, the disclosure of which is herein incorporated by reference. In these embodiments, of interest are N-phenyl-2-pyrimidine-amine derivatives of formula (I):

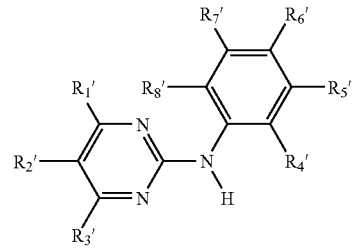

wherein $R_9$, is hydrogen or lower alkyl,

X is oxo, thio, imino, N-lower alkyl-imino, hydroximino or O-lower alkyl-hydroximino, Y is oxygen or the group NH, k is 0 or 1 and $R_{10}$ is an aliphatic radical having at least 5 carbon atoms, or an aromatic, aromatic-aliphatic, cycloaliphatic, cycloaliphatic-aliphatic, heterocyclic or heterocyclic-aliphatic radical, and the remaining radicals $R_{4'}$, $R_{5'}$, $R_{6'}$, $R_7$ and $R_{8'}$ are each independently of the others hydrogen, lower alkyl that is unsubstituted or substituted by free or alkylated amino, piperazinyl, piperidinyl, pyrrolidinyl or by morpholinyl, or lower alkanoyl, trifluoromethyl, free, etherified or esterifed hydroxy, free, alkylated or acylated amino or free or esterified carboxy, and salts of such compounds having at least one salt-forming group.

In these embodiments:

1-Methyl-1 H-pyrrolyl is preferably 1-methyl-1 H-pyrrol-2-yl or 1-methyl-1-H-pyrrol-3-yl Amino- or amino-lower alkyl-substituted phenyl $R_1$ wherein the amino group in each case is free, alkylated or acylated, is phenyl substituted in any desired position (ortho, meta or para) wherein an alkylated amino group is preferably mono- or di-lower alkylamino, for example dimethylamino, and the lower alkyl moiety of amino-lower alkyl is preferably linear $C_1$-$C_3$ alkyl, such as especially methyl or ethyl.

1H-Indolyl bonded at a carbon atom of the five-membered ring is 1H-indol-2-yl or 1H-indol-3-yl.

Unsubstituted or lower alkyl-substituted pyridyl bonded at a ring carbon atom is lower alkyl-substituted or preferably unsubstituted 2-, or preferably 3- or 4-pyridyl, for example 3-pyridyl, 2-methyl-3-pyridyl, 4-methyl-3-pyridyl or 4-pyridyl. Pyridyl substituted at the nitrogen atom by oxygen is a radical derived from pyridine N-oxide, i.e., N-oxido-pyridyl, e.g. N-oxido-4-pyridyl.

Fluoro-substituted lower alkoxy is lower alkoxy carrying at least one, but preferably several, fluoro substituents, especially trifluoromethoxy or preferably 1,1,2,2-tetrafluoroethoxy.

When X is oxo, thio, imino, N-lower alkyl-imino, hydroxyimino or O-lower alkyl-hydroximino, the group C=X is, in the above order, a radical C=O, C=S, C=N—H, C=N-lower alkyl, C=N—OH or CN—O-lower alkyl, respectively. X is preferably oxo.

k is preferably 0, i.e., the group Y is not present.

Y, if present, is preferably the group NH.

The term "lower" within the scope of this text denotes radicals having up to and including 7, preferably up to and including 4 carbon atoms.

Lower alkyl $R_1$, $R_{2'}$, $R_{3'}$ and $R_{9'}$ is preferably methyl or ethyl.

An aliphatic radical $R_{10}$ having at least 5 carbon atoms preferably has not more than 22 carbon atoms, generally not more than 10 carbon atoms, and is such a substituted or preferably unsubstituted aliphatic hydrocarbon radical, that is to say such a substituted or preferably unsubstituted alkynyl, alkenyl or preferably alkyl radical, such as $C_5$-$C_7$ alkyl, for example n-pentyl. An aromatic radical $R_{10}$ has up to 20 carbon atoms and is unsubstituted or substituted, for example in each case unsubstituted or substituted naphthyl, such as especially 2-naphthyl, or preferably phenyl, the substituents preferably being selected from cyano, unsubstituted or hydroxy-, amino- or 4-methyl-piperazinyl-substituted lower alkyl, such as especially methyl, trifluoromethyl, free, etherified or esterified hydroxy, free, alkylated or acylated amino and free or esterified carboxy. In an aromatic-aliphatic radical $R_{10}$ the aromatic moiety is as defined above and the aliphatic moiety is preferably lower alkyl, such as especially $C_1$-$C_2$ alkyl, which is substituted or preferably unsubstituted, for example benzyl. A cycloaliphatic radical $R_{10}$ has especially up to 30, more especially up to 20, and most especially up to 10 carbon atoms, is mono- or poly-cyclic and is substituted or preferably unsubstituted, for example such a cycloalkyl radical, especially such a 5- or 6-membered cycloalkyl radical, such as preferably cyclohexyl. In a cycloaliphatic-aliphatic radical $R_{10}$ the cycloaliphatic moiety is as defined above and the aliphatic moiety is preferably lower alkyl, such as especially $C_1$-$C_2$ alkyl, which is substituted or preferably unsubstituted. A heterocyclic radical $R_{10}$ contains especially up to 20 carbon atoms and is preferably a saturated or unsaturated monocyclic radical having 5 or 6 ring members and 1-3 hetero atoms which are preferably selected from nitrogen, oxygen and sulfur, especially, for example, thienyl or 2-, 3- or 4-pyridyl, or a bi- or tri-cyclic radical wherein, for example, one or two benzene radicals are annellated (fused) to the mentioned monocyclic radical. In a heterocyclic-aliphatic radical $R_{10}$ the heterocyclic moiety is as defined above and the aliphatic moiety is preferably lower alkyl, such as especially $C_1$-$C_2$ alkyl, which is substituted or preferably unsubstituted.

Etherified hydroxy is preferably lower alkoxy. Esterified hydroxy is preferably hydroxy esterified by an organic carboxylic acid, such as a lower alkanoic acid, or a mineral acid, such as a hydrohalic acid, for example lower alkanoyloxy or especially halogen, such as iodine, bromine or especially fluorine or chlorine.

Alkylated amino is for example, lower alkylamino, such as methylamino, or di-lower alkylamino, such as dimethylamino. Acylated amino is, for example, lower alkanoylamino or benzoylamino.

Esterified carboxy is, for example, lower alkoxycarbonyl, such as methoxycarbonyl.

A substituted phenyl radical may carry up to 5 substituents, such as fluorine, but especially in the case of relatively large substituents is generally substituted by only from 1 to 3 substituents. Examples of substituted phenyl that may be given special mention are 4-chloro-phenyl, pentafluoro-phenyl, 2-carboxy-phenyl, 2-methoxy-phenyl, 4-fluorophenyl, 4-cyano-phenyl and 4-methyl-phenyl.

Salt-forming groups in a compound of formula (I) are groups or radicals having basic or acidic properties. Compounds having at least one basic group or at least one basic radical, for example a free amino group, a pyrazinyl radical or a pyridyl radical, may form acid addition salts, for example with inorganic acids, such as hydrochloric acid, sulfuric acid or a phosphoric acid, or with suitable organic carboxylic or sulfonic acids, for example aliphatic mono- or di-carboxylic acids, such as trifluoroacetic acid, acetic acid, propionic acid, glycolic acid, succinic acid, maleic acid, fumaric acid, hydroxymaleic acid, malic acid, tartaric acid, citric acid or oxalic acid, or amino acids such as arginine or lysine, aromatic carboxylic acids, such as benzoic acid, 2-phenoxy-benzoic acid, 2-acetoxybenzoic acid, salicylic acid, 4-aminosalicylic acid, aromatic-aliphatic carboxylic acids, such as mandelic acid or cinnamic acid, heteroaromatic carboxylic acids, such as nicotinic acid or isonicotinic acid, aliphatic sulfonic acids, such as methane-, ethane- or 2-hydroxyethane-sulfonic acid, or aromatic sulfonic acids, for example benzene-, p-toluene- or naphthalene-2-sulfonic acid. When several basic groups are present mono- or poly-acid addition salts may be formed.

Compounds of formula (I) having acidic groups, for example a free carboxy group in the radical $R_{10}$, may form metal or ammonium salts, such as alkali metal or alkaline earth metal salts, for example sodium, potassium, magnesium or calcium salts, or ammonium salts with ammonia or suitable organic amines, such as tertiary monoamines, for example triethylamine or tri-(2-hydroxyethyl)-amine, or heterocyclic bases, for example N-ethylpiperidine or N,N'-dimethyl-piperazine.

Compounds of formula (I) having both acidic and basic groups can form internal salts.

Of particular interest in these embodiments is a pyrimidine derivative in which $R_{1'}$ is 3-pyridyl, $R_{2'}$, $R_{3'}$, $R_{5'}$, $R_{6'}$, and $R_{8'}$ are each hydrogen, $R_{4'}$ is methyl, and $R_{7'}$ is a group of formula (II) in which $R_{9'}$ is hydrogen, X is oxo, k is 0, and $R_{10}$ is 4-[(4-methyl-1-piperazinyl)methyl]phenyl. The mesylate salt of this compound having the chemical name 4-[(4-methyl-1-piperazinyl)methyl]-N-[4-methyl-3-[[4-(3-pyridinyl)-2-pyrimidinyl]amino-phenyl]benzamide methanesulfonate is now commonly known as imatinib mesylate and sold under the trademark Gleevec™.

Endothelin Receptor Antagonists

Endothelin antagonists suitable for use in the present invention include gents that decrease the level of endothelin synthesis, agents that block or inhibit the binding of endothelin to an endothelin receptor, and agents that block or inhibit endothelin receptor-mediated signal transduction. As used herein, the term "endothelin antagonist" refers to any agent that decreases the level of endothelin synthesis, any agent that blocks or inhibits the binding of endothelin to an endothelin receptor, and any agent that blocks or inhibits endothelin receptor-mediated signal transduction.

In some embodiments, an endothelin receptor antagonist is selective for endothelin A (ETA) receptors. In some embodiments, an endothelin receptor antagonist is selective for endothelin B (ETB) receptors. In other embodiments, an endothelin receptor antagonist is an antagonist of both ETA and ETB receptors.

Specific examples of endothelin antagonists useful in the present invention include, but are not limited to, atrasentan (ABT-627; Abbott Laboratories), Veletri™ (tezosentan; Actelion Pharmaceuticals, Ltd.), sitaxsentan (ICOS-Texas Biotechnology), enrasentan (GlaxoSmithKline), darusentan (LU135252; Myogen) BMS-207940 (Bristol-Myers Squibb), BMS-193884 (Bristol-Myers Squibb), BMS-182874 (Bristol-Myers Squibb), J-104132 (Banyu Pharmaceutical), VML 588/Ro 61-1790 (Vanguard Medica), T-0115 (Tanabe Seiyaku), TAK-044 (Takeda), BQ-788 (Banyu Pharmaceutical), BQ123, YM-598 (Yarnanouchi Pharma), PD 145065 (Parke-Davis), A-127722 (Abbott Laboratories), A-192621 (Abbott Laboratories), A-182086 (Abbott Laboratories), TBC3711 (ICOS-Texas Biotechnology), BSF208075 (Myogen), S-0139 (Shionogi), TBC2576 (Texas Biotechnology), TBC3214 (Texas Biotechnology), PD156707 (Parke-Davis), PD180988 (Parke-Davis), ABT-546 (Abbott Laboratories), ABT-627 (Abbott Laboratories), SB247083 (GlaxoSmithKline), SB 209670 (GlaxoSmithKline); and an endothelin receptor antagonists discussed in the art, e.g., Davenport and Battistini (2002) *Clinical Science* 103:15-35, Wu-Wong et al. (2002) *Clinical Science* 103: 1075-1115, and Luescher and Barton (2000) *Circulation* 102: 2434-2440.

A suitable endothelin receptor antagonist is TRACLEER™ (bosentan; manufactured by Actelion Pharmaceuticals, Ltd.). TRACLEER™ is an orally active dual endothelin receptor antagonist, and blocks the binding of endothelin to both of its receptors endothelin receptor A and endothelin receptor B.

TRACLEER™ belongs to a class of highly substituted pyrimidine derivatives, with no chiral centers. It is designated chemically as 4-tert-butyl-N-[6-(2-hydroxy-ethoxy)-5-(2-methoxy-phenoxy)-[2,2']-bipyrimidin-4-yl]-benzene-sulfonamide monohydrate and has the following structural formula:

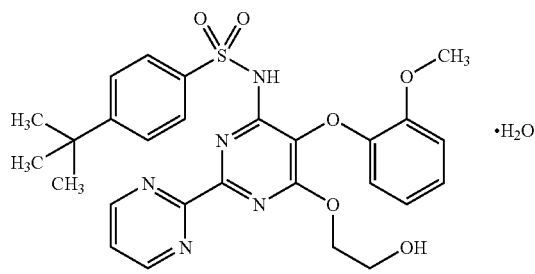

TRACLEER™ treatment is in some embodiments administered at a dose of 62.5 mg bid orally for 4 weeks, followed by a maintenance dose of 125 mg bid orally.

N-Acetylcysteine (NAC)

N-acetylcysteine (NAC) is a stable form of the sulfur amino acid L-cysteine. NAC is an anti-oxidant that scavenges $H_2O_2$ and other radicals. It is a precursor of glutathione (a major antioxidant), providing cysteine substrate for glutathione synthesis. NAC is commercially available as an over-the-counter nutritional supplement or nutraceutical product. Suitable NAC products for use herein include the NAC nutritional supplement products made by Source Naturals (1000 mg tablets), Biochem (750 mg tablets), Twinlab (600 mg tablets), Nutricology/Allergy Research Group (500 mg tablets), and the like. Such products can be purchased at minimal cost from health food stores and nutritional supplement retailers, such as General Nutrion Corporation (GNC).

Thymosin-α

Thymosin-α (Zadaxin™; available from SciClone Pharmaceuticals, Inc., San Mateo, Calif.) is a synthetic form of thymosin alpha 1, a hormone found naturally in the circulation and produced by the thymus gland. Thymosin-α increases activity of T cells and NK cells. Zadaxin™ formulated for subcutaneous injection is a purified sterile lyophilized preparation of chemically synthesized thymosin alpha 1 identical to human thymosin alpha 1. Thymosin alpha 1 is an acetylated polypeptide with the following sequence: Ac-Ser-Asp-Ala-Ala-Val-Asp-Thr-Ser-Ser-Glu-Ile-Thr-Thr-Lys-Asp-Leu-Lys-Glu-Lys-Lys-Glu-Val-Val-Glu-Glu-Ala-Glu-Asn-OH (SEQ ID NO: 103), and having a molecular weight of 3,108 daltons. The lyophilized preparation contains 1.6 mg synthetic thymosin-α, 50 mg mannitol, and sodium phosphate buffer to adjust the pH to 6.8.

Ribavirin

Ribavirin, 1-β-D-ribofuranosyl-1H-1,2,4-triazole-3-carboxamide, available from ICN Pharmaceuticals, Inc., Costa Mesa, Calif., is described in the Merck Index, compound No. 81102, Eleventh Edition. Its manufacture and formulation is described in U.S. Pat. No. 4,211,771. The invention also contemplates use of derivatives of ribavirin (see, e.g., U.S. Pat. No. 6,277,830). The ribavirin may be administered orally in capsule or tablet form, or in the same or different administration form and in the same or different route as the IFN-α (either PEGylated or non-PEGylated form). Of course, other types of administration of both medicaments, as they become available are contemplated, such as by nasal spray, transdermally, by suppository, by sustained release dosage form, etc. Any form of administration will work so long as the proper dosages are delivered without destroying the active ingredient.

Ribavirin is generally administered in an amount ranging from about 400 mg to about 1200 mg, from about 600 mg to about 1000 mg, or from about 700 to about 900 mg per day. In some embodiments, ribavirin is administered throughout the entire course of PEGylated IFN-α or non-PEGylated IFN-α therapy. In other embodiments, ribavirin is administered only during the first period of time. In still other embodiments, ribavirin is administered only during the second period of time.

Levovirin

Levovirin is the L-enantiomer of ribavirin, and exhibits the property of enhancing a Th1 immune response over a Th2 immune response. Levovirin is manufactured by ICN Pharmaceuticals.

Levovirin has the following structure:

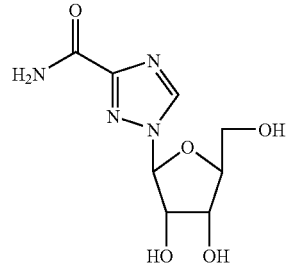

Viramidine

Viramidine is a 3-carboxamidine derivative of ribavirin, and acts as a prodrug of ribavirin. It is efficiently converted to ribavirin by adenosine deaminases.

Viramidine has the following structure:

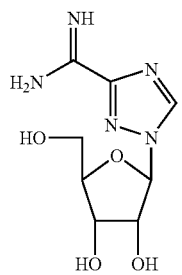

Nucleoside Analogs

Nucleoside analogs that are suitable for use in a subject therapy include, but are not limited to, ribavirin, levovirin, viramidine, isatoribine, an L-ribofuranosyl nucleoside as disclosed in U.S. Pat. No. 5,559,101 and encompassed by Formula I of U.S. Pat. No. 5,559,101 (e.g., 1-β-L-ribofuranosyluracil, 1-β-L-ribofuranosyl-5-fluorouracil, 1-β-L-ribofuranosylcytosine, 9-β-L-ribofuranosyladenine, 9-β-L-ribofuranosylhypoxanthine, 9-β-L-ribofuranosylguanine, 9-β-L-ribofuranosyl-6-thioguanine, 2-amino-α-L-ribofuranl[1′,2′:4,5]oxazoline, $O^2,O^2$-anhydro-1-α-L-ribofuranosyluracil, 1-α-L-ribofuranosyluracil, 1-(2,3,5-tri-O-benzoyl-α-ribofuranosyl)-4-thiouracil, 1-α-L-ribofuranosylcytosine, 1-α-L-ribofuranosyl-4-thiouracil, 1-α-L-ribofuranosyl-5-fluorouracil, 2-amino-α-L-arabinofurano[1′,2′:4,5]oxazoline, $O_2,O^2$-anhydro-β-L-arabinofuranosyluracil, 2′-deoxy-β-L-uridine, 3′5′-Di-O-benzoyl-2′-deoxy-4-thio β-L-uridine, 2′-deoxy-β-L-cytidine, 2′-deoxy-β-L-4-thiouridine, 2′-deoxy-β-L-thymidine, 2′-deoxy-β-L-5-fluorouridine, 2′,3′-dideoxy-β-L-uridine, 2′-deoxy-β-L-5-fluorouridine, and 2′-deoxy-β-L-inosine); a compound as disclosed in U.S. Pat. No. 6,423,695 and encompassed by Formula I of U.S. Pat. No. 6,423,695; a compound as disclosed in U.S. Patent Publication No. 2002/0058635, and encompassed by Formula 1 of U.S. Patent Publication No. 2002/0058635; a nucleoside analog as disclosed in WO 01/90121 A2 (Idenix); a nucleoside analog as disclosed in WO 02/0610203 A2 (Biocryst Pharmaceuticals Inc.); a nucleoside analog as disclosed in WO 02/057287 A2 or WO 02/057425 A2 (both Merck/Isis); and the like.

HCV NS3 Inhibitors

Suitable HCV non-structural protein-3 (NS3) inhibitors include, but are not limited to, a tri-peptide as disclosed in U.S. Pat. Nos. 6,642,204, 6,534,523, 6,420,380, 6,410,531, 6,329,417, 6,329,379, and 6,323,180 (Boehringer-Ingelheim); a compound as disclosed in U.S. Pat. No. 6,143,715 (Boehringer-Ingelheim); a macrocyclic compound as disclosed in U.S. Pat. No. 6,608,027 (Boehringer-Ingelheim); an NS3 inhibitor as disclosed in U.S. Pat. Nos. 6,617,309, 6,608,067, and 6,265,380 (Vertex Pharmaceuticals); an azapeptide compound as disclosed in U.S. Pat. No. 6,624,290 (Schering); a compound as disclosed in U.S. Pat. No. 5,1020,276 (Schering); a compound as disclosed in Pause et al. (2003) *J. Biol. Chem.* 278:20374-20380; NS3 inhibitor BILN 2061 (Boehringer-Ingelheim; Lamarre et al. (2002) *Hepatology* 36:301A; and Lamarre et al. (Oct. 26, 2003) *Nature* doi: 10.1038/nature020102); NS3 inhibitor VX-950 (Vertex Pharmaceuticals; Kwong et al. (Oct. 24-28, 2003) 54th Ann. Meeting AASLD); NS3 inhibitor SCH6 (Abib et al. (Oct. 24-28, 2003) Abstract 137. Program and Abstracts of the 54*th* Annual Meeting of the American Association for the Study of Liver Diseases (AASLD). Oct. 24-28, 2003. Boston, Mass.); any of the NS3 protease inhibitors disclosed in WO 102/07733, WO 102/07734, WO 00/09558, WO 00/09543, WO 00/510229 or WO 02/060926 (e.g., compounds 2, 3, 5, 6, 8, 10, 11, 18, 19, 29, 30, 31, 32, 33, 37, 38, 55, 59, 71, 91, 103, 104, 105, 112, 113, 114, 115, 116, 120, 122, 123, 124, 125, 126 and 127 disclosed in the table of pages 224-226 in WO 02/060926); an NS3 protease inhibitor as disclosed in any one of U.S. Patent Publication Nos. 2003019067, 20030187018, and 20030186895; and the like.

Of particular interest in many embodiments are NS3 inhibitors that are specific NS3 inhibitors, e.g., NS3 inhibitors that inhibit NS3 serine protease activity and that do not show significant inhibitory activity against other serine proteases such as human leukocyte elastase, porcine pancreatic elastase, or bovine pancreatic chymotrypsin, or cysteine proteases such as human liver cathepsin B.

Of particular interest in some embodiments as NS3 inhibitors that inhibit HCV non-structural protein-4 (NS4) helicase activity and that do not show significant inhibitory activity against other serine proteases such as human leukocyte elastase, porcine pancreatic elastase, or bovine pancreatic chymotrypsin, or cysteine proteases such as human liver cathepsin B.

NS5B Inhibitors

Suitable HCV non-structural protein-5 (NS5; RNA-dependent RNA polymerase) inhibitors include, but are not limited to, a compound as disclosed in U.S. Pat. No. 6,479,508 (Boehringer-Ingelheim); a compound as disclosed in any of International Patent Application Nos. PCT/CA02/01127, PCT/CA02/01128, and PCT/CA02/01129, all filed on Jul. 18, 2002 by Boehringer Ingelheim; a compound as disclosed in U.S. Pat. No. 6,440,985 (ViroPharma); a compound as disclosed in WO 01/47883, e.g., JTK-003 (Japan Tobacco); a dinucleotide analog as disclosed in Zhong et al. (2003) *Antimicrob. Agents Chemother.* 47:2674-2681; a benzothiadiazine compound as disclosed in Dhanak et al. (2002) *J. Biol. Chem.* 277(41):38322-7; an NS5B inhibitor as disclosed in WO 02/100846 A1 or WO 02/100851 A2 (both Shire); an NS5B inhibitor as disclosed in WO 01/85172 A1 or WO 02/098424 A1 (both Glaxo SmithKline); an NS5B inhibitor as disclosed in WO 00/06529 or WO 02/06246 A1 (both Merck); an NS5B inhibitor as disclosed in WO 03/000254 (Japan Tobacco); an NS5B inhibitor as disclosed in EP 1 256,628 A2 (Agouron); JTK-002 (Japan Tobacco); JTK-109 (Japan Tobacco); and the like.

Of particular interest in many embodiments are NS5 inhibitors that are specific NS5 inhibitors, e.g., NS5 inhibitors that inhibit NS5 RNA-dependent RNA polymerase and that lack significant inhibitory effects toward other RNA dependent RNA polymerases and toward DNA dependent RNA polymerases.

Alpha-Glucosidase Inhibitors

Alpha-glucosidase inhibitors are a class of oral medications for type 2 diabetes that decrease the absorption of carbohydrates from the intestine, resulting in a slower rise in blood glucose throughout the day, especially following meals, in type 2 diabetic patients. Alpha-glucosidase inhibitors suitable for use in a subject combination therapy include, but are not limited to, n-(n-nonyl)-deoxygalactonojirimycin (n,n-DGJ); N-nonyl-deoxynojirimycin (N-nonyl-DNJ); N-butyl-deoxynojirimycin (NB-DNJ); 1-deoxynoj irimycin (DNM); perbutylated-N-butyl-1-deoxynoj iromycin (p-N-butyl-DNJ); and 6-O-butanoyl castanospermine; and the like.

Additional Antiviral Therapeutic Agents

Additional antiviral therapeutic agents that can be administered in a subject combination therapy include, but are not limited to, alpha-glucosidase inhibitors; inhibitors of inosine monophosphate dehydrogenase (IMPDH); ribozymes that are complementary to viral nucleotide sequences; antisense RNA inhibitors; and the like.

Alpha-Glucosidase Inhibitors

Alpha-glucosidase inhibitors are a class of oral medications for type 2 diabetes that decrease the absorption of carbohydrates from the intestine, resulting in a slower rise in blood glucose throughout the day, especially following meals, in type 2 diabetic patients. Alpha-glucosidase inhibitors suitable for use in a subject combination therapy include, but are not limited to, n-(n-nonyl)-deoxygalactonojirimycin (n,n-DGJ); N-nonyl-deoxynojirimycin (N-nonyl-DNJ); N-butyl-deoxynojirimycin (NB-DNJ); 1-deoxynojirimycin (DNM); perbutylated-N-butyl-1-deoxynojiromycin (p-N-butyl-DNJ); and 6-O-butanoyl castanospermine; and the like.

IMPDH Inhibitors

IMPDH inhibitors that are suitable for use in a subject combination therapy include, but are not limited to, VX-497 ((S)-N-3-[3-(3-methoxy-4-oxazol-5-yl-phenyl)-ureido]-benzyl-carbamic acid tetrahydrofuran-3-yl-ester); Vertex Pharmaceuticals; see, e.g., Markland et al. (2000) *Antimicrob. Agents Chemother.* 44:859-866); ribavirin; levovirin (Ribapharm; see, e.g., Watson (2002) *Curr Opin Investig Drugs* 3(5):680-3); viramidine (Ribapharm); and the like.

Ribozyme and Antisense

Ribozyme and antisense antiviral agents that are suitable for use in a subject combination therapy include, but are not limited to, ISIS 14803 (ISIS Pharmaceuticals/Elan Corporation; see, e.g., Witherell (2001) *Curr Opin Investig Drugs.* 2(11):1523-9); Heptazyme™; and the like.

Side Effect Management Agents

In some embodiments, a subject therapy comprises administering a palliative agent (e.g., an agent that reduces patient discomfort caused by a therapeutic agent), or other agent for the avoidance, treatment, or reduction of a side effect of a therapeutic agent. Such agents are also referred to as "side effect management agents."

Suitable side effect management agents include agents that are effective in pain management; agents that ameliorate gastrointestinal discomfort; analgesics, anti-inflanunatories, antipsychotics, antineurotics, anxiolytics, and hematopoietic agents. In addition, the invention contemplates the use of any compound for palliative care of patients suffering from pain or any other side effect in the course of treatment with a subject therapy. Exemplary palliative agents include acetaminophen, ibuprofen, and other NSAIDs, H2 blockers, and antacids.

Analgesics that can be used to alleviate pain in the methods of the invention include non-narcotic analgesics such as non-steroidal anti-inflammatory drugs (NSAIDs) acetaminophen, salicylate, acetyl-salicylic acid (aspirin, diflunisal), ibuprofen, Motrin, Naprosyn, Nalfon, and Trilisate, indomethacin, glucametacine, acemetacin, sulindac, naproxen, piroxicam, diclofenac, benoxaprofen, ketoprofen, oxaprozin, etodolac, ketorolac tromethamine, ketorolac, nabumetone, and the like, and mixtures of two or more of the foregoing.

Other suitable analgesics include fentanyl, buprenorphine, codeine sulfate, morphine hydrochloride, codeine, hydromorphone (Dilaudid), levorphanol (Levo-Dromoran), methadone (Dolophine), morphine, oxycodone (in Percodan), and oxymorphone (Numorphan). Also suitable for use are benzodiazepines including, but not limited to, flurazepam (Dalmane), diazepam (Valium), and Versed, and the like.

Anti-inflammatory Agents

Suitable anti-inflammatory agents include, but are not limited to, steroidal anti-inflammatory agents, and non-steroidal anti-inflammatory agents.

Suitable steroidal anti-inflammatory agents include, but are not limited to, hydrocortisone, hydroxyltriamcinolone, alpha-methyl dexamethasone, dexamethasone-phosphate, beclomethasone dipropionate, clobetasol valerate, desonide, desoxymethasone, desoxycorticosterone acetate, dexamethasone, dichlorisone, diflorasone diacetate, diflucortolone valerate, fluadrenolone, fluclorolone acetonide, fludrocortisone, flumethasone pivalate, fluosinolone acetonide, fluocinonide, flucortine butylester, fluocortolone, fluprednidene (flupred-nylidene) acetate, flurandrenolone, halcinonide, hydrocortisone acetate, hydrocortisone butyrate, methylprednisolone, triamcinolone acetonide, conisone, cortodoxone, flucetonide, fludrocortisone, difluorosone diacetate, fluradrenolone acetonide, medrysone, amcinafel, amcinafide, betamethasone and the balance of its esters, chloroprednisone, chlorprednisone acetate, clocortelone, clescinolone, dichlorisone, difluprednate, flucloronide, flunisolide, fluoromethalone, fluperolone, fluprednisolone, hydrocortisone valerate, hydrocortisone cyclopentylpropionate, hydrocortamate, meprednisone, paramethasone, prednisolone, prednisone, beclomethasone dipropionate, triamcinolone, and mixtures of two or more of the foregoing.

Suitable non-steroidal anti-inflammatory agents, include, but are not limited to, 1) the oxicams, such as piroxicam, isoxicam, tenoxicam, and sudoxicam; 2) the salicylates, such as aspirin, disalcid, benorylate, trilisate, safapryn, solprin, diflunisal, and fendosal; 3) the acetic acid derivatives, such as diclofenac, fenclofenac, indomethacin, sulindac, tolmetin, isoxepac, furofenac, tiopinac, zidometacin, acematacin, fentiazac, zomepiract, clidanac, oxepinac, and felbinac; 4) the fenamates, such as mefenamic, meclofenamic, flufenarnic, niflumic, and tolfenamic acids; 5) the propionic acid derivatives, such as ibuprofen, naproxen, benoxaprofen, flurbiprofen, ketoprofen, fenoprofen, fenbufen, indoprofen, pirprofen, carprofen, oxaprozin, pranoprofen, miroprofen, tioxaprofen, suprofen, alminoprofen, and tiaprofenic; and 6) the pyrazoles, such as phenylbutazone, oxyphenbutazone, feprazone, azapropazone, and trimethazone, mixtures of these non-steroidal anti-inflammatory agents may also be employed, as well as the pharmaceutically-acceptable salts and esters of these agents.

Suitable anti-inflammatory agents include, but are not limited to, Alclofenac; Alclometasone Dipropionate; Algestone Acetonide; Alpha Amylase; Amcinafal; Amcinafide; Amfenac Sodium; Amiprilose Hydrochloride; Anakinra; Anirolac; Anitrazafen; Apazone; Balsalazide Disodium; Bendazac; Benoxaprofen; Benzydamine Hydrochloride; Bromelains; Broperamole; Budesonide; Carprofen; Cicloprofen; Cintazone; Cliprofen; Clobetasol Propionate; Clobetasone Butyrate; Clopirac; Cloticasone Propionate; Cormethasone Acetate; Cortodoxone; Deflazacort; Desonide; Desoximetasone; -Dexamethasone Dipropionate; Diclofenac Potassium; Diclofenac Sodium; Diflorasone Diacetate; -Diflumidone Sodium; Diflunisal; Difluprednate; Diftalone; Dimethyl Sulfoxide; Drocinonide; Endrysone; Enlimomab Enolicam Sodium; Epirizole; Etodolac; Etofenamate; Felbinac; Fenamole; Fenbufen; Fenclofenac; Fenclorac; Fendosal; Fenpipalone; Fentiazac; Flazalone; Fluazacort; Flufenamic Acid; Flumizole; Flunisolide Acetate; Flunixin; Flunixin Meglumine; Fluocortin Butyl; Fluorometholone Acetate; Fluquazone; Flurbiprofen; Fluretofen; Fluticasone Propionate; Furaprofen; Furobufen; Halcinonide; Halobetasol Propionate; Halopredone Acetate; Ibufenac; Ibuprofen; Ibuprofen Aluminum; Ibuprofen Piconol; Ilonidap; Indomethacin; Indomethacin Sodium; Indoprofen; Indoxole; Intrazole; Isoflupredone Acetate; Isoxepac; Isoxicam; Ketoprofen; Lofemizole Hydrochloride; Lomoxicam; Loteprednol Etabonate; Meclofenamate Sodium; Meclofenamic Acid; Meclorisone Dibutyrate; Mefenamic Acid; Mesalamine; Meseclazone; Methylprednisolone Suleptanate; Morniflumate; Nabumetone; Naproxen; Naproxen Sodium; Naproxol; Nimazone; Olsalazine Sodium; Orgotein; Orpanoxin; Oxaprozin; Oxyphenbutazone; Paranyline Hydrochloride; Pentosan Polysulfate Sodium; Phenbutazone Sodium Glycerate; Pirfenidone; Piroxicam; Piroxicam Cinnamate; Piroxicam Olamine; Pirprofen; Prednazate; Prifelone; Prodolic Acid; Proquazone; Proxazole; Proxazole Citrate; Rimexolone; Romazarit; Salcolex; Salnacedin; Salsalate; Sanguinarium Chloride; Seclazone; Sermetacin; Sudoxicam; Sulindac; Suprofen; Talmetacin; Talniflumate; Talosalate; Tebufelone; Tenidap; Tenidap Sodium; Tenoxicam; Tesicam; Tesimide; Tetrydamine; Tiopinac; Tixocortol Pivalate; Tolmetin; Tolmetin Sodium; Triclonide; Triflumidate; Zidometacin; Zomepirac Sodium.

Antipsychotic and antineurotic drugs that can be used to alleviate psychiatric side effects in the methods of the invention include any and all selective serotonin receptor inhibitors (SSRIs) and other anti-depressants, anxiolytics (e.g. alprazolam), etc. Anti-depressants include, but are not limited to, serotonin reuptake inhibitors such as Celexa®, Desyrel®, Effexor®, Luvox®, Paxil®, Prozac®, Zoloft®, and Serzone®; tricyclics such as Adapin®, Anafrinil®, Elavil®, Janimmineg, Ludiomil®, Pamelor®, Tofranil®, Vivactil®, Sinequan®, and Surmontil®; monoamine oxidase inhibitors such as Eldepryl®, Marplan®, Nardil®, and Parnate®. Anti-anxiety agents include, but are not limited to, azaspirones such as BuSpar®, benzodiazepines such as Ativan®, Librium®, Tranxene®, Centrax®, Klonopin®, Paxipam®, Serax®, Valium®, and Xanax®; and beta-blockers such as Inderal® and Tenormin®.

Agents that reduce gastrointestinal discomfort such as nausea, diarrhea, gastrointestinal cramping, and the like are suitable palliative agents for use in a subject combination therapy. Suitable agents include, but are not limited to, antiemetics, anti-diarrheal agents, H2 blockers, antacids, and the like.

Suitable H2 blockers (histamine type 2 receptor antagonists) that are suitable for use as a palliative agent in a subject therapy include, but are not limited to, Cimetidine (e.g., Tagamet, Peptol, Nu-cimet, apo-cimetidine, non-cimetidine); Ranitidine (e.g., Zantac, Nu-ranit, Novo-randine, and apo-ranitidine); and Famotidine (Pepcid, Apo-Famotidine, and Novo-Famotidine).

Suitable antacids include, but are not limited to, aluminum and magnesium hydroxide (Maalox®, Mylanta®); aluminum carbonate gel (Basajel®); aluminum hydroxide (Amphojel®, AltemaGEL®); calcium carbonate (Tums®, Titralac®); magnesium hydroxide; and sodium bicarbonate.

Antiemetics include, but are not limited to, 5-hydroxytryptophan-3 (5HT3) inhibitors; corticosteroids such as dexamethasone and methylprednisolone; Marinol® (dronabinol); prochlorperazine; benzodiazepines; promethazine; and metoclopramide cisapride; Alosetron Hydrochloride; Batanopride Hydrochloride; Bemesetron; Benzquinamide; Chlorpromazine; Chlorpromazine Hydrochloride; Clebopride; Cyclizine Hydrochloride; Dimenhydrinate; Diphenidol; Diphenidol Hydrochloride; Diphenidol Pamoate; Dolasetron Mesylate; Domperidone; Dronabinol; Fludorex; Flumeridone; Galdansetron Hydrochloride; Granisetron; Granisetron Hydrochloride; Lurosetron Mesylate; Meclizine Hydrochloride; Metoclopramide Hydrochloride; Metopimazine; Ondansetron Hydrochloride; Pancopride; Prochlorperazine; Prochlorperazine Edisylate; Prochlorperazine Maleate; Promethazine Hydrochloride; Thiethylperazine; Thiethylperazine Malate; Thiethylperazine Maleate; Trimethobenzamide Hydrochloride; Zacopride Hydrochloride.

Anti-diarrheal agents include, but are not limited to, Rolgamidine, Diphenoxylate hydrochloride (Lomotil), Metronidazole (Flagyl), Methylprednisolone (Medrol), Sulfasalazine (Azulfidine), and the like.

Suitable hematopoietic agents that can be used to prevent or restore depressed blood cell populations in the methods of the invention include erythropoietins, such as EPOGEN™ epoetin-alfa, granulocyte colony stimulating factors (G-CSFs), such as NEUPOGEN™ filgrastim, granulocyte-macrophage colony stimulating factors (GM-CSFs), thrombopoietins, etc.

Treatment Methods

The present invention provides a method of treating a disease, disorder, or condition in a patient. In one aspect, a subject treatment method utilizes an oral pharmaceutical formulation comprising a known hyperglycosylated, protease-resistant polypeptide variant of a parent protein therapeutic, the known protease-resistant polypeptide variant comprising at least one mutated protease cleavage site in place of a native protease cleavage site that is present in the parent protein therapeutic; and comprising: i) a carbohydrate moiety covalently attached to at least one non-native glycosylation site that is not present in the parent protein therapeutic; or ii) a carbohydrate moiety covalently attached to at least one native glycosylation site that is present but is not glycosylated in the parent protein therapeutic. The oral pharmaceutical composition is administered orally to the patient in an amount whereby the patient receives a first number of moles of the known hyperglycosylated, protease-resistant polypeptide variant at a first dosing interval. The first number of moles of the known hyperglycosylated, protease-resistant variant is greater than a second number of moles of the parent protein therapeutic in a parenteral pharmaceutical composition. The parenteral pharmaceutical composition is an immediate release formulation suitable for subcutaneous bolus injection, and the parent polypeptide is proven to be effective in the treatment of the disease, disorder or condition in the patient when administered to the patient by subcutaneous bolus injection in an amount of the parenteral pharmaceutical composition whereby the patient receives the second number of moles of the parent protein therapeutic at a second dosing interval. In a subject method of treating a disease in a patient, the method comprises administering orally to the patient the oral pharmaceutical composition in an amount whereby the patient receives the first number of moles of the known hyperglycosylated, protease-resistant polypeptide variant at the first dosing interval that is the same as or shorter than the second dosing interval.

Thus, the known hyperglycosylated, protease-resistant polypeptide variant is effective in the treatment of the disease, disorder or condition in a patient when administered to the patient orally at a dosage of the first number of moles at the first dosing interval for a desired treatment duration.

In another aspect, the invention provides a modification of the above-described method of treating a disease, disorder or condition in a patient, where the oral pharmaceutical composition comprising the known hyperglycosylated, protease-resistant polypeptide variant is administered orally to the patient in a first dose at a first dosing frequency, where the parenteral pharmaceutical composition is proven to be effective in the treatment of the disease in a patient when administered to the patient by subcutaneous bolus injection of a second dose of the parent protein therapeutic at a second dosing frequency, where the first dose in moles of the known hyperglycosylated, protease-resistant polypeptide variant per kilogram of patient body weight is greater than the second dose in moles of the parent protein therapeutic per kilogram of patient body weight when the first and second doses are calculated for the same patient body weight, and where upon oral administration of the first dose of the known hyperglycosylated, protease-resistant polypeptide variant to the patient, all of the known hyperglycosylated, protease-resistant polypeptide variant in the first dose is released in a period of time no greater than the period of time between doses in the second dosing frequency. In some embodiments, the parenteral pharmaceutical composition is proven to be effective in the treatment of the disease, disorder or condition in the patient when administered to the patient in a weight-based dose of the parent protein therapeutic at the second dosing interval, i.e., the second dose is a weight-based dose and the parenteral pharmaceutical composition is in a form that allows weight-based dosing. In some of the foregoing embodiments, the first dose is a weight-based dose of the known hyperglycosylated, protease-resistant polypeptide variant and the oral pharmaceutical composition is in a form that allows weight-based dosing.

In another aspect, the invention provides a modification of the above-described method of treating a disease, disorder or condition in a patient, where the oral pharmaceutical composition comprising the known hyperglycosylated, protease-resistant polypeptide variant is administered orally to the patient in a first dose at a first dosing frequency, where the parenteral pharmaceutical composition is proven to be effective in the treatment of the disease, disorder or condition in a patient when administered to the patient by subcutaneous bolus injection of a second dose of the parent protein therapeutic at a second dosing frequency, where the first dose in moles of the known hyperglycosylated, protease-resistant polypeptide variant per kilogram of patient body weight is greater than the second dose in moles of the parent protein therapeutic per kilogram of patient body weight when the first and second doses are calculated for the same patient body weight, and where the time period between doses in the first dosing frequency is the same as or shorter than the time period between doses in the second dosing frequency. In some embodiments, the parenteral pharmaceutical composition is proven to be effective in the treatment of the disease, disorder or condition in the patient when administered to the patient in a weight-based dose of the parent protein therapeutic at the second dosing interval, i.e., the second dose is a weight-based dose and the parenteral pharmaceutical composition is in a form that allows weight-based dosing. In some of the foregoing embodiments, the first dose is a weight-based dose and the oral pharmaceutical composition is in a form that allows weight-based dosing.

The choice of hyperglycosylated, protease-resistant polypeptide variant will depend in part on the disease, disorder, or condition being treated. As noted above, the desired hyperglycosylated, protease-resistant polypeptide variant is effective to treat the disease, disorder, or condition that is treatable with a parent protein therapeutic. The following are non-limiting examples.

Treatment Methods Using IFN-α

In one aspect, where the known hyperglycosylated, protease-resistant polypeptide variant is a known hyperglycosylated, protease-resistant IFN-α, a subject method provides for administering to an individual in need thereof a therapeutically effective amount of a known hyperglycosylated, protease-resistant IFN-α in a method of treating a viral infection, e.g., a hepatitis C virus (HCV) infection. In some embodiments, the method generally comprises orally administering a known hyperglycosylated, protease-resistant polypeptide variant of a parent IFN-α 2 to an individual in need thereof in a first dose at a first dosing frequency that is at least as frequent, or more frequent, than a second dosing frequency proven to be effective in a regimen for treatment of HCV infection comprising administering to an individual in need thereof a parenteral formulation of the parent IFN-α 2 in a second dose at the second dosing frequency, where the first dose comprises a first number of moles of the known hyperglycosylated, protease-resistant polypeptide variant that is greater than a second number of moles of the parent IFN-α 2 in the second dose.

In one non-limiting example, the parent IFN-α 2 is proven to be effective in the treatment of HCV infection in a method comprising administering to a patient in need thereof 3 million units (or 15 micrograms) of IFN-α 2 by subcutaneous bolus injection three times per week for 48 weeks. In some of these embodiments, the hyperglycosylated or protease-resistant, hyperglycosylated polypeptide variant of the parent IFN-α2 can be, e.g., selected from the group of the [D102N] IFN-α 2a, [D102N, D108N]IFN-α 2a, [D102N]IFN-α 2b, and [D102N, D108N]IFN-α 2b glycopeptide variants (where the amino acid numbering is as set forth in FIG. 24); where the variant further comprises one or more single amino acid replacements at one or more target positions corresponding to any of amino acid positions: 41, 58, 78, 107, 117, 125, 133 and 159 (where the amino acid numbering is as set forth in FIG. 2), or any of the mutations depicted in Table 1, such that the variant comprises at least one mutated protease cleavage site in place of a native protease cleavage site found in the parent IFN-α 2. The variant is administered orally to the patient in the first dose containing the first number of moles of the variant at the first dosing frequency, where the first number of moles is greater than the number of moles of the parent IFN-α2 in 3 million units (or 15 micrograms) of the parent IFN-α 2, and where the first dosing frequency is at least three times per week. Alternatively, the first dosing frequency is four times per week, five times per week, six times per week, once per day, twice per day, or three times per day.

In some embodiments, the invention provides any of the foregoing methods of treating HCV infection with a hyperglycosylated or protease-resistant, hyperglycosylated polypeptide variant of IFN-α 2, in which the hyperglycosylated or protease-resistant, hyperglycosylated polypeptide variant comprises any of the carrier peptides described in Table 9 above in a covalent or non-covalent association with the desired polypeptide variant. In some of these embodiments, the hyperglycosylated or protease-resistant, hyperglycosylated polypeptide variant comprises any such carrier peptide in a direct or indirect covalent linkage with the desired polypeptide variant, including without limitation any such carrier peptide fused to the N-terminus of the desired polypeptide variant.

In another non-limiting example, the parent IFN-α 2 is proven to be effective in the treatment of HCV infection in a method comprising administering to a patient in need thereof 15 micrograms (or $8.0 \times 10^{-10}$ mol.) of IFN-α 2 by subcutaneous bolus injection three times per week for 48 weeks. In some of these embodiments, the hyperglycosylated or protease-resistant, hyperglycosylated polypeptide variant of the parent IFN-α 2 can be, e.g., selected from the group of the [D102N]IFN-α 2a, [D102N, D108N]IFN-α 2a; [D102N] IFN-α 2b, and [D102N, D108N]IFN-α 2b glycopeptide variants (where the amino acid numbering is as set forth in FIG. 24); where the variant further comprises one or more single amino acid replacements at one or more target positions corresponding to any of amino acid positions: 41, 58, 78, 107, 117, 125, 133 and 159 (where the amino acid numbering is as set forth in FIG. 2), or any of the mutations depicted in Table 1, such that the variant comprises at least one mutated protease cleavage site in place of a native protease cleavage site found in the parent IFN-α 2; and the variant is administered orally to the patient in the first dose containing the first number of moles of the variant at the first dosing frequency, where the first number of moles is greater than $8.0 \times 10^{-10}$ mol., or at least about $1.6 \times 10^{-9}$ mol., or at least about $2.4 \times 10^{-9}$ mol., or at least about $3.2 \times 10^{-9}$ mol., or at least about $4.0 \times 10^{-9}$ mol., or at least about $4.8 \times 10^{-9}$ mol., or at least about $5.6 \times 10^{-9}$ mol., or at least about $6.4 \times 10^{-9}$ mol., or at least about $7.2 \times 10^{-9}$ mol., or at least about $8.0 \times 10^{-9}$ mol., or at least about $8.0 \times 10^{-8}$ mol., and where the first dosing frequency is at least three times per week. Alternatively, the first dosing frequency is four times per week, five times per week, six times per week, once per day, twice per day, or three times per day.

In another aspect, where the hyperglycosylated or protease-resistant, hyperglycosylated polypeptide variant is a hyperglycosylated or protease-resistant, hyperglycosylated consensus IFN-α, a subject method provides for administering to an individual in need thereof a therapeutically effective amount of the hyperglycosylated or protease-resistant, hyperglycosylated consensus IFN-α in a method of treating a viral infection, e.g., a hepatitis C virus (HCV) infection. In some embodiments, the method generally comprises orally administering a hyperglycosylated or protease-resistant, hyperglycosylated polypeptide variant of a parent consensus IFN-α to an individual in need thereof in a first dose and at a first dosing frequency that is at least as frequent, or more frequent, than a second dosing frequency proven to be effective in a regimen for treatment of HCV infection comprising administering to an individual in need thereof a parenteral formulation of the parent consensus IFN-α in a second dose at the second dosing frequency, where the first dose comprises a first number of moles of the hyperglycosylated or protease-resistant, hyperglycosylated polypeptide variant that is greater than a second number of moles of the parent consensus IFN-α in the second dose.

In one non-limiting example, the parent interferon alfacon-1 is proven to be effective in the treatment of HCV infection in a method comprising administering to a patient in need thereof 9 million units (or 9 micrograms) of INFERGEN® interferon alfacon-1 by subcutaneous bolus injection three times per week for 48 weeks. In some of these embodiments, the hyperglycosylated or protease-resistant, hyperglycosylated polypeptide variant of the parent interferon alfacon-1 can be, e.g., selected from the group of the [D102N] interferon alfacon-1, [D102N, D108N]interferon alfacon-1, [D102N, D108N, E138N] interferon alfacon-1, [D108N, E138N] interferon alfacon-1, [E138N]interferon alfacon-1, and [D102N, E138N] interferon alfacon-1 glycopeptides (where the amino acid numbering is as set forth in FIG. 24); where the glycopeptide further comprises one or more single amino acid replacements at one or more target positions corresponding to any of amino acid positions: 41, 58, 78, 107, 117, 125, 133 and 159 (where the amino acid numbering is as set forth in FIG. 9), such that the variant comprises at least one mutated protease cleavage site in place of a native protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than the number of moles of interferon alfacon-1 in 9 million units (or 9 micrograms) of interferon alfacon-1, and where the first dosing frequency is at least three times per week. Alternatively, the first dosing frequency is four times per week, five times per week, six times per week, once per day, twice per day, or three times per day.

In another non-limiting example, the parent interferon alfacon-1 is proven to be effective in the treatment of HCV infection in a method comprising administering to a patient in need thereof 15 million units (or 15 micrograms) of INFERGEN® interferon alfacon-1 by subcutaneous bolus injection three times per week for 48 weeks. In some of these embodiments, the hyperglycosylated or protease-resistant, hyperglycosylated polypeptide variant of the parent interferon alfacon-1 can be, e.g., selected from the group of the [D102N] interferon alfacon-1, [D102N, D108N]interferon alfacon-1, [D102N, D108N, E138N] interferon alfacon-1, [D108N, E138N] interferon alfacon-1, [E138N]interferon alfacon-1, and [D102N, E138N]interferon alfacon-1 glycopeptides (where the amino acid numbering is as set forth in FIG. 24); where the glycopeptide further comprises one or more single amino acid replacements at one or more target positions corresponding to any of amino acid positions: 41, 58, 78, 107, 117, 125, 133 and 159 (where the amino acid numbering is as set forth in FIG. 9), such that the variant comprises at least one mutated protease cleavage site in place of a native protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than the number of moles of interferon alfacon-1 in 15 million units (or 15 micrograms) of interferon alfacon-1, and where the first dosing frequency is at least three times per week. Alternatively, the first dosing frequency is four times per week, five times per week, six times per week, once per day, twice per day, or three times per day.

In another non-limiting example, the parent interferon alfacon-1 is proven to be effective in the treatment of HCV infection in a method comprising administering to a patient in need thereof 9 micrograms (or $4.6 \times 10^{-10}$ mol.) of interferon alfacon-1 by subcutaneous bolus injection three times per week for 48 weeks. In some of these embodiments, the hyperglycosylated or protease-resistant, hyperglycosylated polypeptide variant of the parent interferon alfacon-1 can be, e.g., selected from the group of the [D102N]interferon alfacon-1, [D102N, D108N]interferon alfacon-1, [D102N, D108N, E138N]interferon alfacon-1, [D108N, E138N]interferon alfacon-1, [E138N]interferon alfacon-1, and [D102N, E138N]interferon alfacon-1 glycopeptides (where the amino acid numbering is as set forth in FIG. 24); where the glycopeptide further comprises one or more single amino acid replacements at one or more target positions corresponding to any of amino acid positions: 41, 58, 78, 107, 117, 125, 133 and 159 (where the amino acid numbering is as set forth in FIG. 9), such that the variant comprises at least one mutated protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than $4.6 \times 10^{-10}$ mol., or at least about $9.2 \times 10^{-10}$ mol., or at least about $1.4 \times 10^{-9}$ mol., or at least about $1.8 \times 10^{-9}$ mol., or at least about $2.3 \times 10^{-9}$ mol., or at least about $2.8 \times 10^{-9}$ mol., or at least about $3.2 \times 10^{-9}$ mol., or at least about $3.7 \times 10^{-9}$ mol., or at least about $4.1 \times 10^{-9}$ mol., or at least about $4.6 \times 10^{-9}$ mol., or at least about $4.6 \times 10^{-8}$ mol., and where the first dosing frequency is at least three times per week. Alternatively, the first dosing frequency is four times per week, five times per week, six times per week, once per day, twice per day, or three times per day.

In another non-limiting example, the parent interferon alfacon-1 is proven to be effective in the treatment of HCV infection in a method comprising administering to a patient in need thereof 15 micrograms (or $7.6 \times 10^{-10}$ mol.) of interferon alfacon-1 by subcutaneous bolus injection three times per week for 48 weeks. In some of these embodiments, the hyperglycosylated or protease-resistant, hyperglycosylated polypeptide variant of the parent interferon alfacon-1 can be, e.g., selected from the group of the [D102N]interferon alfacon-1, [D102N, D108N]interferon alfacon-1, [D102N, D108N, E138N]interferon alfacon-1, [D108N, E138N]interferon alfacon-1, [E138N]interferon alfacon-1, and [D102N, E138N]interferon alfacon-1 glycopeptides, where the glycopeptide further comprises one or more single amino acid replacements at one or more target positions corresponding to any of amino acid positions: 41, 58, 78, 107, 117, 125, 133 and 159, such that the variant comprises at least one mutated protease cleavage site in place of a native protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than $7.6 \times 10^{-10}$ mol., or at least about $1.5 \times 10^{-9}$ mol., or at least about $2.3 \times 10^{-9}$ mol., or at least about $3.0 \times 10^{-9}$ mol., or at least about $3.8 \times 10^{-9}$ mol., or at least about $4.6 \times 10^{-9}$ mol., or at least about $5.3 \times 10^{-9}$ mol., or at least about $6.1 \times 10^{-9}$ mol., or at least about $6.8 \times 10^{-9}$ mol., or at least about $7.6 \times 10^{-9}$ mol., or at least about $7.6 \times 10^{-8}$ mol., and where the first dosing frequency is at least three times per week. Alternatively, the first dosing frequency is four times per week, five times per week, six times per week, once per day, twice per day, or three times per day.

In another non-limiting example, the parent interferon alfacon-1 is proven to be effective in the treatment of HCV infection in a method comprising administering to a patient in need thereof 9 micrograms (or $4.5 \times 10^{-8}$ mol.) of interferon alfacon-1 by subcutaneous bolus injection once per day for 48 weeks. In some of these embodiments, the hyperglycosylated or protease-resistant, hyperglycosylated polypeptide variant of the parent interferon alfacon-1 can be, e.g., selected from the group of the [D102N]interferon alfacon-1, [D102N, D108N]interferon alfacon-1, [D102N, D108N, E138N]interferon alfacon-1, [D108N, E138N]interferon alfacon-1, [E138N]interferon alfacon-1, and [D102N, E138N]interferon alfacon-1 glycopeptides, where the glycopeptide further comprises one or more single amino acid replacements at one or more target positions corresponding to any of amino acid positions: 41, 58, 78, 107, 117, 125, 133 and 159, such that the variant comprises at least one mutated protease cleavage site in place of a native protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than $4.6 \times 10^{-10}$ mol., or at least about $9.2 \times 10^{-10}$ mol., or at least about $1.4 \times 10^{-9}$ mol., or at least about $1.8 \times 10^{-9}$ mol., or at least about $2.3 \times 10^{-9}$ mol., or at least about $2.8 \times 10^{-9}$ mol., or at least about $3.2 \times 10^{-9}$ mol., or at least about $3.7 \times 10^{-9}$ mol., or at least about $4.1 \times 10^{-9}$ mol., or at least about $4.6 \times 10^{-9}$ mol., or at least about $4.6 \times 10^{-8}$ mol., and where the first dosing frequency is at least once per day. Alternatively, the first dosing frequency is twice per day or three times per day.

In another non-limiting example, the parent interferon alfacon-1 is proven to be effective in the treatment of HCV infection in a method comprising administering to a patient in need thereof 15 micrograms (or $7.5 \times 10^{-8}$ mol.) of interferon alfacon-1 by subcutaneous bolus injection once per day for 48 weeks. In some of these embodiments, the hyperglycosylated or protease-resistant, hyperglycosylated polypeptide variant of the parent interferon alfacon-1 can be, e.g., selected from the group of the [D102N]interferon alfacon-1, [D102N, D108N]interferon alfacon-1, [D102N, D108N, E138N]interferon alfacon-1, [D108N, E138N]interferon alfacon-1, [E138N]interferon alfacon-1, and [D102N, E138N]interferon alfacon-1 glycopeptides, where the glycopeptide further comprises one or more single amino acid replacements at one or more target positions corresponding to any of amino acid positions: 41, 58, 78, 107, 117, 125, 133 and 159, such that the variant comprises at least one mutated protease cleavage site in place of a native protease cleavage site found in the parent consensus IFN-α; and administered orally to the patient in the first dose containing the first number of moles of the hyperglycosylated or protease-resistant, hyperglycosylated polypeptide variant at the first dosing frequency, where the first number of moles is greater than $7.6 \times 10^{-10}$ mol., or at least about $1.5 \times 10^{-9}$ mol., or at least about $2.3 \times 10^{-9}$ mol., or at least about $3.0 \times 10^{-9}$ mol., or at least about $3.8 \times 10^{-9}$ mol., or at least about $4.6 \times 10^{-9}$ mol., or at least about $5.3 \times 10^{-9}$ mol., or at least about $6.1 \times 10^{-9}$ mol., or at least about $6.8 \times 10^{-9}$ mol., or at least about $7.6 \times 10^{-9}$ mol., or at least about $7.6 \times 10^{-8}$ mol., and where the first dosing frequency is at least once per day. Alternatively, the first dosing frequency is twice per day or three times per day.

In some embodiments, the invention provides any of the foregoing methods of treating HCV infection with a hyperglycosylated or protease-resistant, hyperglycosylated polypeptide variant of a consensus IFN-α, in which the hyperglycosylated or protease-resistant, hyperglycosylated polypeptide variant comprises any of the carrier peptides described in Table 9 above in a covalent or non-covalent association with the desired polypeptide variant. In some of these embodiments, the hyperglycosylated or protease-resistant, hyperglycosylated polypeptide variant comprises any such carrier peptide in a direct or indirect covalent linkage with the desired polypeptide variant, including without limitation any such carrier peptide fused to the N-terminus of the desired polypeptide variant.

Treatment Methods Using IFN-γ

In another aspect, where the hyperglycosylated or protease-resistant, hyperglycosylated polypeptide variant is a hyperglycosylated IFN-γ, a subject method provides for administering to an individual in need thereof a therapeutically effective amount of a hyperglycosylated or protease-resistant, hyperglycosylated IFN-γ in a method of treating a viral infection, e.g., an HCV infection. In some embodiments, the method generally comprises orally administering a hyperglycosylated or protease-resistant, hyperglycosylated polypeptide variant of a parent IFN-γ to an individual in need thereof in a first dose at a first dosing frequency that is at least as frequent, or more frequent, than a second dosing frequency proven to be effective in a regimen for treatment of HCV infection comprising administering to an individual in need thereof a therapeutically effective amount of an IFN-α and co-administering to the individual a parenteral formulation of the parent IFN-γ in a second dose at the second dosing frequency, where the first dose comprises a first number of moles of the hyperglycosylated or protease-resistant, hyperglycosylated polypeptide variant that is greater than a second number of moles of the parent IFN-γ in the second dose.

In one non-limiting example, the parent IFN-γ is IFN-γ 1b and is proven to be effective in the treatment of HCV infection in a method comprising administering to a patient in need thereof a therapeutically effective amount of an IFN-α and co-administering to the patient 100 micrograms ($6.0 \times 10^{-9}$ mol.) of IFN-γ 1b by subcutaneous bolus injection three times per week for 48 weeks. In some of these embodiments, the hyperglycosylated or protease-resistant, hyperglycosylated polypeptide variant of the parent IFN-γ 1b can be, e.g., selected from the group of the [S102T]IFN-γ, [E38N]IFN-γ, [E38N, S40T]IFN-γ, [E38N, S102T]IFN-γ, and [E38N, S40T, S102T]IFN-γ glycopeptides, where the glycopeptide variant further comprises one or more of the amino acid replacements set forth in Table 3 (IFN-γ), such that the glycopeptide variant comprises at least one mutated protease cleavage site in place of a native protease cleavage site found in the parent IFN-γ polypeptide; and administered orally to the patient in the first dose containing the first number of moles of the hyperglycosylated or protease-resistant, hyperglycosylated polypeptide variant at the first dosing frequency, where the first number of moles is greater than the number of moles of IFN-γ 1b in 100 micrograms ($6.0 \times 10^{-9}$ mol.) of IFN-γ 1b, and where the first dosing frequency is at least three times per week. Alternatively, the first dosing frequency is four times per week, five times per week, six times per week, once per day, twice per day, or three times per day.

In another non-limiting example, the parent IFN-γ is IFN-γ 1b and is proven to be effective in the treatment of HCV infection in a method comprising administering to a patient in need thereof a therapeutically effective amount of an IFN-α and co-administering to the patient 50 micrograms ($3.0 \times 10^{-9}$ mol.) of IFN-γ 1b by subcutaneous bolus injection three times per week for 48 weeks. In some of these embodiments, the hyperglycosylated or protease-resistant, hyperglycosylated polypeptide variant of the parent IFN-γ 1b can be, e.g., selected from the group of the [S102T]IFN-γ, [E38N]IFN-γ, [E38N, S40T]IFN-γ, [E38N, S102T]IFN-γ, and [E38N, S40T, S102T]IFN-γ glycopeptides, where the glycopeptide variant further comprises one or more of the amino acid replacements set forth in Table 3 (IFN-γ), such that the glycopeptide variant comprises at least one mutated protease cleavage site in place of a native protease cleavage site found in the parent IFN-γ polypeptide; and administered orally to the patient in the first dose containing the first number of moles of the hyperglycosylated or protease-resistant, hyperglycosylated polypeptide variant at the first dosing frequency, where the first number of moles is greater than the number of moles of IFN-γ 1b in 50 micrograms ($3.0 \times 10^{-9}$ mol.) of IFN-γ 1b, and where the first dosing frequency is at least three times per week. Alternatively, the first dosing frequency is four times per week, five times per week, six times per week, once per day, twice per day, or three times per day.

In another non-limiting example, the parent IFN-γ is IFN-γ 1b and is proven to be effective in the treatment of HCV infection in a method comprising administering to a patient in need thereof a therapeutically effective amount of an IFN-α and co-administering to the patient 100 micrograms ($6.0 \times 10^{-9}$ mol.) of IFN-γ 1b by subcutaneous bolus injection three times per week for 48 weeks. In some of these embodiments, the hyperglycosylated or protease-resistant, hyperglycosylated polypeptide variant of the parent IFN-γ 1b can be, e.g., selected from the group of the [S102T]IFN-γ, [E38N]IFN-γ, [E38N, S40T]IFN-γ, [E38N, S102T]IFN-γ, and [E38N, S40T, SI O$_2$T]IFN-γ glycopeptides, where the glycopeptide variant further comprises one or more of the amino acid replacements set forth in Table 3 (IFN-γ), such that the glycopeptide variant comprises at least one mutated protease cleavage site in place of a native protease cleavage site found in the parent IFN-γ polypeptide; and administered orally to the patient in the first dose containing the first number of moles of the hyperglycosylated or protease-resistant, hyperglycosylated polypeptide variant at the first dosing frequency, where the first number of moles is greater than $6.0 \times 10^{-9}$ mol., or at least about $1.2 \times 10^{-8}$ mol., or at least about $1.8 \times 10^{-8}$ mol., or at least about $2.4 \times 10^{-8}$ mol., or at least about $3.0 \times 10^{-8}$ mol., or at least about $3.6 \times 10^{-8}$ mol., or at least about $4.2 \times 10^{-8}$ mol., or at least about $4.8 \times 10^{-8}$ mol., or at least about $5.4 \times 10^{-8}$ mol., or at least about $6.0 \times 10^{-8}$ mol., or at least about $6.0 \times 10^{-7}$ mol., and where the first dosing frequency is at least three times per week. Alternatively, the first dosing frequency is four times per week, five times per week, six times per week, once per day, twice per day, or three times per day.

In another non-limiting example, the parent IFN-γ is IFN-γ 1b and is proven to be effective in the treatment of HCV infection in a method comprising administering to a patient in need thereof a therapeutically effective amount of an IFN-α and co-administering to the patient 50 micrograms ($3.0 \times 10^{-9}$ mol.) of IFN-γ 1b by subcutaneous bolus injection three times per week for 48 weeks. In some of these embodiments, the hyperglycosylated or protease-resistant, hyperglycosylated polypeptide variant of the parent IFN-γ 1b can be, e.g., selected from the group of the [S102T]IFN-γ, [E38N]IFN-γ, [E38N, S40T]IFN-γ, [E38N, S102T]IFN-γ, and [E38N, S40T, S102T]IFN-γ glycopeptides, where the glycopeptide variant further comprises one or more of the amino acid replacements set forth in Table 3 (IFN-γ), such that the glycopeptide variant comprises at least one mutated protease cleavage site in place of a native protease cleavage site found in the parent IFN-γ polypeptide; and administered orally to the patient in the first dose containing the first number of moles of the hyperglycosylated or protease-resistant, hyperglycosylated polypeptide variant at the first dosing frequency, where the first number of moles is greater than $3.0 \times 10^{-9}$ mol., or at least about $6.0 \times 10^{-9}$ mol., or at least about $9.0 \times 10^{-9}$ mol., or at least about $1.2 \times 10^{-8}$ mol., or at least about $1.5 \times 10^{-8}$ mol., or at least about $1.8 \times 10^{-8}$ mol., or at least about $2.1 \times 10^{-8}$ mol., or at least about $2.4 \times 10^{-8}$ mol., or at least about $2.7 \times 10^{-8}$ mol., or at least about $3.0 \times 10^{-8}$ mol., or at least about $3.0 \times 10^{-7}$ mol., and where the first dosing frequency is at least three times per week. Alternatively, the first dosing frequency is four times per week, five times per week, six times per week, once per day, twice per day, or three times per day.

In some embodiments, the invention provides any of the foregoing methods of treating HCV infection with a hyperglycosylated or protease-resistant, hyperglycosylated polypeptide variant of a IFN-γ, in which the hyperglycosylated or protease-resistant, hyperglycosylated polypeptide variant comprises any of the carrier peptides described in Table 9 above in a covalent or non-covalent association with the desired polypeptide variant. In some of these embodiments, the hyperglycosylated or protease-resistant, hyperglycosylated polypeptide variant comprises any such carrier peptide in a direct or indirect covalent linkage with the desired polypeptide variant, including without limitation any such carrier peptide fused to the N-terminus of the desired polypeptide variant.

Therapeutically effective amounts of IFN-α suitable for use in the present methods of treating HCV infection with IFN-α and IFN-γ combination therapy are provided in the methods for treating HCV infection with IFN-α therapy described under the heading "Treatment Methods Using IFN-α" above. In addition, therapeutically effective amounts of IFN-α suitable for use in the present methods of treating HCV infection with IFN-α and IFN-γ combination therapy are provided in the methods for treating HCV infection with IFN-α and IFN-γ combination therapy described in WO 03/030613.

In another aspect, where the hyperglycosylated or protease-resistant, hyperglycosylated polypeptide variant is a hyperglycosylated IFN-γ, a subject method provides for administering to an individual in need thereof a therapeutically effective amount of a hyperglycosylated or protease-resistant, hyperglycosylated IFN-γ in a method of treating a fibrotic disorder, e.g., a pulmonary fibrotic disorder or a liver fibrotic disorder. In some embodiments, the method generally comprises orally administering a hyperglycosylated or protease-resistant, hyperglycosylated polypeptide variant of a parent IFN-γ to an individual in need thereof in a first dose at a first dosing frequency that is at least as frequent, or more frequent, than a second dosing frequency proven to be effective in a regimen for treatment of the fibrotic disorder comprising administering to an individual in need thereof a parenteral pharmaceutical formulation of the parent IFN-γ in a second dose at the second dosing frequency, where the first dose comprises a first number of moles of the hyperglycosylated or protease-resistant, hyperglycosylated polypeptide variant that is greater than a second number of moles of the parent IFN-γ in the second dose.

In one non-limiting example, the parent IFN-γ is IFN-γ 1b and is proven to be effective in the treatment of a fibrotic disorder in a method comprising administering to a patient in need thereof 200 micrograms ($1.2 \times 10^{-8}$ mol.) of IFN-γ 1b by subcutaneous bolus injection three times per week for 1 year or more. In some of these embodiments, the hyperglycosylated or protease-resistant, hyperglycosylated polypeptide variant of the parent IFN-γ 1b can be, e.g., selected from the group of the [S102T]IFN-γ, [E38N]IFN-γ, [E38N, S40T] IFN-γ, [E38N, S102T]IFN-γ, and [E38N, S40T, S102T] IFN-γ glycopeptides, where the glycopeptide variant further comprises one or more of the amino acid replacements set forth in Table 3 (IFN-γ), such that the glycopeptide variant comprises at least one mutated protease cleavage site in place of a native protease cleavage site found in the parent IFN-γ polypeptide; and administered orally to the patient in the first dose containing the first number of moles of the hyperglycosylated or protease-resistant, hyperglycosylated polypeptide variant at the first dosing frequency, where the first number of moles is greater than $1.2 \times 10^{-8}$ mol., or at least about $2.4 \times 10^{-8}$ mol., or at least about $3.6 \times 10^{-8}$ mol., or at least about $4.8 \times 10^{-8}$ mol., or at least about $6.0 \times 10^{-8}$ mol., or at least about $7.2 \times 10^{-8}$ mol., or at least about $8.4 \times 10^{-8}$ mol., or at least about $9.6 \times 10^{-8}$ mol., or at least about $1.1 \times 10^{-7}$ mol., or at least about $1.2 \times 10^{-7}$ mol., or at least about $1.0 \times 10^{-6}$ mol., and where the first dosing frequency is at least three times per week. Alternatively, the first dosing frequency, where the first dosing frequency is four times per week, five times per week, six times per week, once per day, twice per day, or three times per day.

In some embodiments, the invention provides any of the foregoing methods of treating a fibrotic disorder with a hyperglycosylated or protease-resistant, hyperglycosylated polypeptide variant of IFN-γ, where the fibrotic disorder is a pulmonary fibrotic disorder, such as idiopathic pulmonary fibrosis, or a liver fibrotic disorder. In some of the subject methods of treating idiopathic pulmonary fibrosis, the patient has an initial forced vital capacity (FVC)≧55% of the predicted normal FVC. In other methods of the invention for treating idiopathic pulmonary fibrosis, the patient has an initial carbon monoxide diffusing capacity ($DL_{CO}$)≧35% of the predicted normal $DL_{CO}$. In still other methods of the invention for treating idiopathic pulmonary fibrosis, the patient has an initial forced vital capacity (FVC)≧55% of the predicted normal FVC and an initial carbon monoxide diffusing capacity ($DL_{CO}$)≧35% of the predicted normal $DL_{CO}$.

In some embodiments, the invention provides any of the foregoing methods of treating a fibrotic disorder with a hyperglycosylated or protease-resistant, hyperglycosylated polypeptide variant of an IFN-γ, in which the hyperglycosylated or protease-resistant, hyperglycosylated polypeptide variant comprises any of the carrier peptides described in Table 9 above in a covalent or non-covalent association with the desired polypeptide variant. In some of these embodiments, the hyperglycosylated or protease-resistant, hyperglycosylated polypeptide variant comprises any such carrier peptide in a direct or indirect covalent linkage with the desired polypeptide variant, including without limitation any such carrier peptide fused to the N-terminus of the desired polypeptide variant.

In some embodiments, the invention provides any of the foregoing methods of treating a disease in a patient with a hyperglycosylated or protease-resistant, hyperglycosylated polypeptide variant of a parent IFN-γ 1b therapeutic, where the method is modified to use any protease-resistant variant of glycosylated native (wild-type) human IFN-γ (described in WO 02/081507) as the hyperglycosylated or protease-resistant, hyperglycosylated polypeptide-variant of the parent IFN-γ 1b therapeutic. In one non-limiting example, the protease-resistant variant of glycosylated native human IFN-γ comprises one or more of the amino acid replacements set forth in Table 3 (IFN-γ), such that the variant comprises at least one mutated protease cleavage site in place of a native protease cleavage site in the parent IFN-γ 1b polypeptide.

Treatment Methods Using IFN-β

In some embodiments, where the hyperglycosylated or protease-resistant, hyperglycosylated polypeptide variant is a hyperglycosylated or protease-resistant, hyperglycosylated IFN-β, a subject method provides for administering to an individual in need thereof a therapeutically effective amount of the hyperglycosylated or protease-resistant, hyperglycosylated IFN-β in a method of treating multiple sclerosis. The method generally comprises orally administering a hyperglycosylated or protease-resistant, hyperglycosylated polypeptide variant of a parent IFN-β to an individual in need thereof in a first dose at a first dosing frequency that is at least as frequent, or more frequent, than a second dosing frequency proven to be effective in a regimen for treatment of multiple sclerosis comprising administering to an individual in need thereof a parenteral formulation of the parent IFN-β in a second dose at the second dosing frequency, where the first dose comprises a first number of moles of the hyperglycosylated or protease-resistant, hyperglycosylated polypeptide variant that is greater than a second number of moles of the parent IFN-β in the second dose.

In one non-limiting example, the parent IFN-β1 therapeutic is IFN-β1b and is proven to be effective in the treatment of multiple sclerosis in a method comprising administering to a patient in need thereof 0.25 mg (or 1.35×10$^{-8}$ mol.) IFN-β1b (BETASERON®) by subcutaneous bolus injection every other day for the desired treatment duration. In some of these embodiments, the hyperglycosylated or protease-resistant, hyperglycosylated polypeptide variant is a known protease-resistant variant of the active ingredient of AVONEX® IFN-β1a, (e.g., where the protease-resistant variant comprises one or more of the amino acid changes set forth in Table 2) and is administered orally to the patient in the first dose containing the first number of moles of the variant at the first dosing frequency, where the first number of moles is greater than 1.35×10$^{-8}$ mol., or at least about 2.7×10$^{-8}$ mol., or at least about 4.0×10$^{-8}$ mol., or at least about 5.4×10$^{-8}$ mol., or at least about 6.75×10$^{-8}$ mol., or at least about 8.1×10$^{-8}$ mol., or at least about 9.45×10$^{-8}$ mol., or at least about 1.1×10$^{-7}$ mol., or at least about 1.2×10$^{-7}$ mol., or at least about 1.35×10$^{-7}$ mol., or at least about 1.35×10$^{-6}$ mol., and where the first dosing frequency is at least every other day. Alternatively, the first dosing frequency is four times per week, five times per week, six times per week, once per day, twice per day, or three times per day.

Treatment Methods Using Erythropoietin (EPO)

In some embodiments, where the hyperglycosylated or protease-resistant, hyperglycosylated polypeptide variant is a hyperglycosylated or protease-resistant, hyperglycosylated EPO, a subject method provides for administering to an individual in need thereof a therapeutically effective amount of a hyperglycosylated or protease-resistant, hyperglycosylated EPO in a method of treating anemia. The method generally comprises orally administering a hyperglycosylated or protease-resistant, hyperglycosylated polypeptide variant of a parent EPO to an individual in need thereof in a first dose at a first dosing frequency that is at least as frequent, or more frequent, than a second dosing frequency proven to be effective in a regimen for treatment of anemia comprising administering to an individual in need thereof a parenteral formulation of the parent EPO in a second dose at the second dosing frequency, where the first dose comprises a first number of moles of the hyperglycosylated or protease-resistant, hyperglycosylated polypeptide variant that is greater than a second number of moles of the parent EPO in the second dose.

In one non-limiting example, the parent EPO is proven to be effective in the treatment of anemia in a method comprising administering to a patient in need thereof 100 Units (770 micrograms or 2.5×10$^{-8}$ mol.) EPOGEN® epoetin alfa per kilogram of patient body weight by subcutaneous bolus injection three times per week for the desired treatment duration. In some of these embodiments, the hyperglycosylated or protease-resistant, hyperglycosylated polypeptide variant is a protease-resistant variant of the active ingredient of ARANESP® darbepoetin alfa, (e.g., where the protease-resistant or protease-resistant, hyperglycosylated variant comprises one or more of the amino acid changes set forth in Table 4) and administered orally to the patient in the first dose containing the first number of moles of the variant at the first dosing frequency, where the first number of moles is the product of greater than 2.5×10$^{-8}$ mol., or at least about 5.0×10$^{-8}$ mol., or at least about 7.5×10$^{-8}$ mol., or at least about 1.0×10$^{-7}$ mol., or at least about 1.25×10$^{-7}$ mol., or at least about 1.5×10$^{-7}$ mol., or at least about 1.75×10$^{-7}$ mol., or at least about 2.0×10$^{-7}$ mol., or at least about 2.25×10$^{-7}$ mol., or at least about 2.5×10$^{-7}$ mol., or at least about 2.5×10$^{-6}$ mol., per kilogram of the patient's body weight multiplied by the patient's body weight, and where the first dosing frequency is at least three times per week. Alternatively, the first dosing frequency is four times per week, five times per week, six times per week, once per day, twice per day, or three times per day.

In another non-limiting example, the parent EPO is proven to be effective in the treatment of anemia in a method comprising administering to a patient in need thereof 50 Units (385 micrograms or 1.25×10$^{-8}$ mol.) EPOGEN® epoetin alfa per kilogram of patient body weight by subcutaneous bolus injection three times per week for the desired treatment duration. In some of these embodiments, the hyperglycosylated or protease-resistant, hyperglycosylated polypeptide variant is a known protease-resistant variant of the active ingredient of ARANESP® darbepoetin alfa, (e.g., where the protease-resistant or protease-resistant, hyperglycosylated variant comprises one or more of the amino acid changes set forth in Table 4) and is administered orally to the patient in the first dose containing the first number of moles of the variant at the first dosing frequency, where the first number of moles is the product of greater than 1.25×10$^{-8}$ mol., or at least about 2.5×10$^{-8}$ mol., or at least about 3.75×10$^{-8}$ mol., or at least about 5.0×10$^{-8}$ mol., or at least about 6.25×10$^{-8}$ mol., or at least about 7.5×10$^{-8}$ mol., or at least about 8.75×10$^{-8}$ mol., or at least about 1.0×10$^{-7}$ mol., or at least about 1.125×10$^{-7}$ mol., or at least about 1.25×10$^{-7}$ mol., or at least about 1.25×10$^{-6}$ mol., per kilogram of the patient's body weight multiplied by the patient's body weight, and where the first dosing frequency is at least three time per week. Alternatively, the first dosing frequency is four times per week, five times per week, six times per week, once per day, twice per day, or three times per day.

Treatment Methods Using Parenterally—Administered Hyperglycosylated Type I Interferon Variants for Acute Viral Infection or for Cancer In some embodiments, where the hyperglycosylated or protease-resistant, hyperglycosylated polypeptide variant is a hyperglycosylated or protease-resistant, hyperglycosylated Type 1 interferon, a subject method provides for administering to an individual in need thereof a therapeutically effective amount of a hyperglycosylated or protease-resistant, hyperglycosylated polypeptide variant parenterally, especially by intravenous administration. Such an administration is useful to ensure a controlled setting during therapeutic dosing thus affording greater patient compliance with dosing regimens and more effective management of acute side effects. Such an administration is useful in management of acute viral infection, particularly in epidemic or pandemic viral infections, as a single dose or a minimal number of doses is designated for treatment.

In another non-limiting example, the parent interferon alfacon-1 is proven to be effective in the treatment of acute viral infection in a method comprising administering to a patient in need thereof 9 micrograms (or 4.5×10$^{-8}$ mol.) of interferon alfacon-1 by parenteral, especially intravenous, bolus injection one time.

In another non-limiting example, the parent interferon alfacon-1 is proven to be effective in the treatment of acute viral infection in a method comprising administering to a patient in need thereof 9 micrograms (or 4.5×10$^{-8}$ mol.) of interferon alfacon-1 by parenteral, especially intravenous, bolus injection daily for not more than seven days.

In another non-limiting example, the parent interferon alfacon-1 is proven to be effective in the treatment of acute viral infection in a method comprising administering to a patient in need thereof 9 micrograms (or 4.5×10$^{-8}$ mol.) of interferon alfacon-1 by parenteral, especially intravenous, bolus injection daily for not more than 14 days.

In another non-limiting example, the parent interferon alfacon-1 is proven to be effective in the treatment of acute viral infection in a method comprising administering to a patient in need thereof 9 micrograms (or $4.5 \times 10^{-8}$ mol.) of interferon alfacon-1 by parenteral, especially intravenous, bolus injection daily for not more than 21 days.

In another non-limiting example, the parent interferon alfacon-1 is proven to be effective in the treatment of acute viral infection in a method comprising administering to a patient in need thereof 15 micrograms (or $7.5 \times 10^{-8}$ mol.) of interferon alfacon-1 by parenteral, especially intravenous, bolus injection one time.

In another non-limiting example, the parent interferon alfacon-1 is proven to be effective in the treatment of acute viral infection in a method comprising administering to a patient in need thereof 15 micrograms (or $7.5 \times 10^{-8}$ mol.) of interferon alfacon-1 by parenteral, especially intravenous, bolus injection daily for not more than 7 days.

In another non-limiting example, the parent interferon alfacon-1 is proven to be effective in the treatment of acute viral infection in a method comprising administering to a patient in need thereof 15 micrograms (or $7.5 \times 10^{-8}$ mol.) of interferon alfacon-1 by parenteral, especially intravenous, bolus injection daily for not more than 14 days.

In another non-limiting example, the parent interferon alfacon-1 is proven to be effective in the treatment of acute viral infection in a method comprising administering to a patient in need thereof 15 micrograms (or $7.5 \times 10^{-8}$ mol.) of interferon alfacon-1 by parenteral, especially intravenous, bolus injection daily for not more than 21 days.

In another non-limiting example, the parent interferon alfacon-1 is proven to be effective in the treatment of acute viral infection in a method comprising administering to a patient in need thereof more than 15 micrograms (or $7.5 \times 10^{-8}$ mol.) of interferon alfacon-1 by parenteral, especially intravenous, bolus injection one time.

In another non-limiting example, the parent interferon alfacon-1 is proven to be effective in the treatment of acute viral infection in a method comprising administering to a patient in need thereof more than 15 micrograms (or $7.5 \times 10^{-8}$ mol.) of interferon alfacon-1 by parenteral, especially intravenous, bolus injection for not more than 7 days.

In another non-limiting example, the parent interferon alfacon-1 is proven to be effective in the treatment of acute viral infection in a method comprising administering to a patient in need thereof more than 15 micrograms (or $7.5 \times 10^{-8}$ mol.) of interferon alfacon-1 by parenteral, especially intravenous, bolus injection for not more than 14 days.

In another non-limiting example, the parent interferon alfacon-1 is proven to be effective in the treatment of acute viral infection in a method comprising administering to a patient in need thereof more than 15 micrograms (or $7.5 \times 10^{-8}$ mol.) of interferon alfacon-1 by parenteral, especially intravenous, bolus injection for not more than 21 days.

Kits and Containers

The present invention provides a container comprising a hyperglycosylated or protease-resistant, hyperglycosylated polypeptide variant. The invention further provides a kit comprising a formulation comprising a unit dosage form of a hyperglycosylated or protease-resistant, hyperglycosylated polypeptide variant in a container, and a label that provides instructions for use of the kit.

Suitable containers include those adapted for administration by subcutaneous injection, including a syringe (for use with a needle), an injector pen, and the like. In some embodiments, a subject agonist is administered with a pen injector (e.g., a medication delivery pen), a number of which are known in the art. Exemplary devices which can be adapted for use in the present methods are any of a variety of pen injectors from Becton Dickinson, e.g., BD™ Pen, BD™ Pen II, BD™ Auto-Injector; a pen injector from Innoject, Inc.; any of the medication delivery pen devices discussed in U.S. Pat. Nos. 5,728,074, 6,096,010, 6,146,361, 6,248,095, 6,277,0102, and 6,221,053; and the like. The medication delivery pen can be disposable, or reusable and refillable. Also suitable for use is an Intraject® needle-free injection system (Aradigm Corp.).

The invention further provides a drug delivery device comprising (e.g., pre-loaded with) a reservoir containing a liquid formulation that comprises a single dose of a subject glycosylated synthetic Type I interferon receptor polypeptide agonist. In some embodiments, the present invention provides a pre-filled syringe comprising a pharmaceutical composition comprising a subject glycosylated synthetic Type I interferon receptor polypeptide agonist.

The present invention provides formulations comprising a subject glycosylated synthetic Type I interferon receptor polypeptide agonist and a glycosylated IFN-γ in a single liquid formulation that is contained in a single reservoir, for use in a drug delivery device. In some aspects, the present invention provides a drug reservoir or other container containing a subject glycosylated synthetic Type I interferon receptor polypeptide agonist and a glycosylated IFN-γ co-formulated in a liquid, wherein both the subject glycosylated synthetic Type I interferon receptor polypeptide agonist and glycosylated IFN-γ are present in the formulation in an amount suitable for one dose each. The reservoir can be provided in any of a variety of forms, including, but not limited to, a cartridge, a syringe, a reservoir of a continuous delivery device, and the like.

The invention further provides a drug delivery device comprising (e.g., pre-loaded with) a reservoir containing a liquid formulation that comprises a single dose of a subject glycosylated synthetic Type I interferon receptor polypeptide agonist and a single dose of glycosylated IFN-γ. Exemplary, non-limiting drug delivery devices include injections devices, such as pen injectors, needle/syringe devices, continuous delivery devices, and the like. Any of the dosage amounts, including synergistically effective amounts, described herein can be used in the pharmaceutical formulation, in the reservoir, or in the drug delivery device.

In some embodiments, the present invention provides a pre-filled syringe comprising a pharmaceutical composition comprising a subject glycosylated synthetic Type I interferon receptor polypeptide agonist, a glycosylated IFN-γ, and a pharmaceutically acceptable excipient, where the subject glycosylated synthetic Type I interferon receptor polypeptide agonist and the glycosylated IFN-γ are co-formulated.

In other embodiments, the present invention provides a syringe comprising (a) a first barrel pre-filled with a pharmaceutical composition comprising a subject glycosylated synthetic Type I interferon receptor polypeptide agonist; (b) a second barrel pre-filled with a pharmaceutical composition comprising a glycosylated IFN-γ.

In some embodiments, the present invention provides a container comprising a hyperglycosylated or protease-resistant, hyperglycosylated polypeptide variant in a formulation suitable for oral delivery. Formulations suitable for oral delivery include liquid formulations, solid formulations (e.g., tablets, capsules, and the like), and semi-solid formulations (e.g., gels, gel capsules, etc.).

Subjects Suitable for Treatment

The subject methods are suitable for treating individuals having, or susceptible to having, a variety of disorders. In many embodiments, the individual is a human.

Fibrotic Disorders

The subject methods for treating fibrotic disorders are suitable for treatment of individuals diagnosed as having a fibrotic disorder. Fibrotic disorders include, but are not limited to, pulmonary fibrosis, including idiopathic pulmonary fibrosis (IPF) and pulmonary fibrosis from a known etiology, liver fibrosis, and renal fibrosis. Other exemplary fibrotic conditions include musculoskeletal fibrosis, cardiac fibrosis, post-surgical adhesions, scleroderma, glaucoma, and skin lesions such as keloids.

Cancer

Subjects suitable for treatment with a subject method for treating cancer include individuals having any type of cancer. Also suitable for treatment are individuals who have failed previous treatment for a cancer with a standard cancer chemotherapeutic agent. Also suitable for treatment are individuals who have been previously treated with a standard cancer chemotherapeutic agent, who initially responded to such treatment, and in whom the cancer subsequently reappeared. Also suitable for treatment are individuals who failed to respond to treatment with another agent for treating cancer. Also suitable for treatment are individuals who failed to comply with dosing regimens required for treatment with interferon therapeutics or another agent for treating cancer. Also suitable for treatment are individuals who require management of acute side effects of chemotherapeutic regimens for treating cancer.

HCV Infection

Individuals who are to be treated according to the methods of the invention for treating an HCV infection include individuals who have been clinically diagnosed as infected with HCV. Individuals who are infected with HCV are identified as having HCV RNA in their blood, and/or having anti-HCV antibody in their serum.

Individuals who are clinically diagnosed as infected with HCV include naïve individuals (e.g., individuals not previously treated for HCV, particularly those who have not previously received IFN-α-based and/or ribavirin-based therapy) and individuals who have failed prior treatment for HCV ("treatment failure" patients). Treatment failure patients include non-responders (i.e., individuals in whom the HCV titer was not significantly or sufficiently reduced by a previous treatment for HCV, e.g., a previous IFN-α monotherapy, a previous IFN-α and ribavirin combination therapy, or a previous pegylated IFN-α and ribavirin combination therapy); and relapsers (i.e., individuals who were previously treated for HCV, e.g., who received a previous IFN-α monotherapy, a previous IFN-α and ribavirin combination therapy, or a previous pegylated IFN-α and ribavirin combination therapy, whose HCV titer decreased, and subsequently increased).

In particular embodiments of interest, individuals have an HCV titer of at least about 105, at least about 5×105, or at least about $10^6$, or at least about $2 \times 10^6$, genome copies of HCV per milliliter of serum. The patient may be infected with any HCV genotype (genotype 1, including 1a and 1b, 2, 3, 4, 6, etc. and subtypes (e.g., 2a, 2b, 3a, etc.)), particularly a difficult to treat genotype such as HCV genotype 1 and particular HCV subtypes and quasispecies.

Also of interest are HCV-positive individuals (as described above) who exhibit severe fibrosis or early cirrhosis (non-decompensated, Child's-Pugh class A or less), or more advanced cirrhosis (decompensated, Child's-Pugh class B or C) due to chronic HCV infection and who are viremic despite prior anti-viral treatment with IFN-α-based therapies or who cannot tolerate IFN-α-based therapies, or who have a contraindication to such therapies. In particular embodiments of interest, HCV-positive individuals with stage 3 or 4 liver fibrosis according to the METAVIR scoring system are suitable for treatment with the methods of the present invention. In other embodiments, individuals suitable for treatment with the methods of the instant invention are patients with decompensated cirrhosis with clinical manifestations, including patients with far-advanced liver cirrhosis, including those awaiting liver transplantation. In still other embodiments, individuals suitable for treatment with the methods of the instant invention include patients with milder degrees of fibrosis including those with early fibrosis (stages 1 and 2 in the METAVIR, Ludwig, and Scheuer scoring systems; or stages 1, 2, or 3 in the Ishak scoring system.).

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1

Construction of hybrid Type I Interferon Receptor Polypeptide Agonists with Non-Native Glycosylation Sites Among Type I interferons, two interferon alpha subtypes (IFN alpha 2b and 14), IFN beta 1 and IFN Omega 1 are naturally glycosylated in mammalian cells (FIG. 24). FIG. 24 provides an amino acid sequence comparison of the amino acid sequences of Infergen (SEQ ID NO:1356) and Type I Interferon species (SEQ ID NOs:1357-1360) that have been reported to be glycosylated naturally. The amino acid residues where the glycosylations occur are labeled with bold outlined boxes. The asparagines residues are the anchoring site for N-link glycosylation and the threonine residue is the anchoring site for O-link glycosylation. The majority sequence is shown above (SEQ ID NO:1355).

Based on the high degree of amino acid sequence identity between Infergen and other Type I interferons, glycosylation sites were designed in Infergen on the basis of amino acid sequence alignment of Infergen with the naturally glycosylated type I interferons (FIG. 25). FIG. 25 provides an amino acid sequence comparison of the amino acid sequences of amino acids 61-120 of Infergen (SEQ ID NO:1362) and various embodiments of subject glycosylated mutants (SEQ ID NOs:1363-1373). Sites 1, 2 and 3 are examples of positions where glycosylation sites are created. Only N-link glycosylation sites are generated at Sites 1 and 2. Both N-link and O-link glycosylation sites are generated at Site 3. N-linked and O-linked glycosylation sites were engineered into Infergen. N-linked glycosylation involves a unique oligosaccharide branch structure that is attached to an asparagine residue found in an Asn-X-Ser/Thr motif. O-linked glycosylation consists of an oligosaccharide chain or glycosaminoglycan chains added to the OH group of serine or threonine residues. A majority sequence is shown above (SEQ ID NO:1361).

Experimental Design

Designing an Infergen gene optimized for expression in human cells. Currently, Infergen is produced in *E. coli* and therefore contains codons optimized for bacterial expression. Glycosylated Infergen must be generated in mammalian cell lines. To increase the protein expression level in mammalian cells, a new Infergen gene with mammalian codon usage preference (Table 8) was designed and synthesized using the most frequent codon for each amino acid is selected (FIG. 26). FIG. 26 depicts an exemplary synthetic mammalian Infergen nucleic acid sequence with preferred mammalian codon usage. The open reading frame is indicated with translated Infergen amino acid sequence (SEQ ID NO:1356). Six pairs of complementary primers from A to F are shown in alternating italics and bold text. The upper sense strands of the primer pairs are identified with odd number and lower nonsense strands are identified with even number. In the region upstream of the start codon ATG, a short sequence of GCCACC, the Kozak consensus sequence, is designed to increase eukaryotic translation efficiency. Two tandem stop codons —TAA and TGA— are used to ensure complete termination of translation. Table 8 (above) provides mammalian codon usage preference. From, "Molecular Cloning: A Laboratory Manual" Sambrook J. and Russell D. W. Third Edition (2001) Cold Spring Harbor Press.

Strategies for construction of synthetic Mammalian Infergen gene. Since the new Mammalian Infergen DNA sequence is synthetic rather than naturally occurring, chemical synthesis of the gene is the reasonable route of synthesis. Typically chemical synthesis of a gene involves the synthesis short oligonucleotides, their annealing, ligation and cloning into a plasmid. A total of 6 pairs of oligonucleotides were used to produce a synthetic mammalian Infergen gene (FIG. 26).

Each pair of annealed primers has terminal sequence that allows it to anneal to the adjacent oligonucleotide. The 5' and 3' end of the synthetic gene contain Hind III and Eco RI restriction endonuclease sites, respectively, which allows ligation into the plasmid. Detailed sequence information of these primers is given (Table 11).

TABLE 11

Sequences of primers for chemical gene synthesis of Mammalian Infergen.

| Primer | Sense | Sequence (in 5' to 3' orientation |
|---|---|---|
| | Yes | [Phosp] AGCTTGCCACCATGTGCGACCTGCCCCAGACCCACAGCCTGGGCAACCGCCGCGCCCTGATCCTGCTGGCCCAGATGCGCCGCATCAGCCCC (SEQ ID NO:1338) |
| | No | [Phosp] GCGGCGCATCTGGGCCAGCAGGATCAGGGCGCGGCGGTTGCCCAGGCTGTGGGTCTGGGGCAGGTCGCACATGGTGGCA (SEQ ID NO:1339) |
| | Yes | [Phosp] TTCAGCTGCCTGAAGGACCGCCACGACTTCGGCTTCCCCCAGGAGGAGTTCGACGGCAACCAGTTCCAGAAGGCCCAGGCCATCAGCG (SEQ ID NO:1340) |
| | No | [Phosp] CCTGGGCCTTCTGGAACTGGTTGCCGTCGAACTCCTCCTGGGGGAAGCCGAAGTCGTGGCGGTCCTTCAGGCAGCTGAAGGGGCTGAT (SEQ ID NO:1341) |
| | Yes | [Phosp] TGCTGCACGAGATGATCCAGCAGACCTTCAACCTGTTCAGCACCAAGGACAGCAGCGCCGCCTGGGACGAGAGCCTGCTGGAGAAG (SEQ ID NO:1342) |

TABLE 11-continued Sequences of primers for chemical gene synthesis of Mammalian Infergen.

| Primer Sense | Sequence (in 5' to 3' orientation |
|---|---|
| No | [Phosp] AGGCTCTCGTCCCAGGCGGCGCTGCTGTCCTTGGTGC TGAACAGGTTGAAGGTCTGCTGGATCATCTCGTGC AGCACGCTGATGG (SEQ ID NO:1343) |
| Yes | [Phosp] TTCTACACCGAGCTGTACCAGCAGCTGAACGACCTG GAGGCCTGCGTGATCCAGGAGGTGGGCGTGGAGGAG ACCCCCCTGATGAACGTGG (SEQ ID NO:1344) |
| No | [Phosp] TCAGGGGGGTCTCCTCCACGCCCACCTCCTGGATCAC GCAGGCCTCCAGGTCGTTCAGCTGCTGGTACAGCT CGGTGTAGAACTTCTCCAGC (SEQ ID NO:1345) |
| Yes | [Phosp] ACAGCATCCTGGCCGTGAAGAAGTACTTCCAGCGCAT CACCCTGTACCTGACCGAGAAGAAGTACAGCCCCT GCGCCTGGGAGGTGG (SEQ ID NO:1346) |
| No | [Phosp] AGGCGCAGGGGCTGTACTTCTTCTCGGTCAGGTACAGG GTGATGCGCTGGAAGTACTTCTTCACGGCCAGGA TGCTGTCCACGTTCA (SEQ ID NO:1347) |
| Yes | [Phosp] TGCGCGCCGAGATCATGCGCAGCTTCAGCCTGAGCAC CAACCTGCAGGAGCGCCTGCGCCGCAAGGAGTAAT GAG (SEQ ID NO:1348) |
| No | [Phosp] AATTCTCATTACTCCTTGCGGCGCAGGCGCTCCTGCA GGTTGGTGCTCAGGCTGAAGCTGCGCATGATCTCG GCGCGCACCACCTCCC (SEQ ID NO:1349) |

Strategies for generating Mammalian Infergen glycosylation mutants. The sequence changes needed to produce mammalian, glycosylation competent Infergen are minor and can be introduced into the synthetic gene by standard site directed mutagenesis techniques (FIG. 27). FIG. 27 depicts a comparison of the nucleic acid sequences of Mammalian Infergen (SEQ ID NO:1375) and glycosylated mutants thereof (SEQ ID NOs:1376-1386); with the majority sequence shown above (SEQ ID NO:1374). The nucleotides that differ are shown in boxes. Codons used based on the preferred codon usage in mammals (Table 8). The nucleotides that differ from the majority sequence are shown in boxes.

FIG. 28 depicts an amino acid sequence comparison of human Interferon beta 1 (SEQ ID NO:1391) and exemplary IFN-β1 glycosylated mutants (SEQ ID NOs:1392-1396); with the majority sequence (SEQ ID NO:1390) shown above. Sites 1 and 2 are the positions where glycosylation mutants are generated. In general, only N-linked glycosylation sites are created at Site 1. Both N-linked and O-linked glycosylation sites are generated at Site 2. The naturally occurring N-linked glycosylation sites in human IFN-β1 and mutants are shown in boxes.

FIG. 29 depicts an amino acid sequence comparison of human Interferon omega-1 (SEQ ID NO:1398) and exemplary glycosylation mutants (SEQ ID NOs:1399-1403); with the majority sequence (SEQ ID NO:1397) shown above. Sites 1 and 2 are the positions where glycosylation mutants are generated. In general, only N-linked glycosylation sites are created at Site 1. Both N-linked and O-linked glycosylation sites are generated at Site 2. The naturally occurring N-linked glycosylation sites in human IFN-ω1 and mutants are shown in boxes.

Example 2

Design, Construction, Expression and Glycosylation Sites Generation of Mammalian Infergen Fusion constructs with Other Type I Interferon Signal Peptides Materials and Methods Construction of Fusion Genes The amino acid alignments of Infergen, and exemplary Infergen fusion proteins, human Interferon Alpha 14 and Beta are shown in FIG. 30. A two-step polymerase chain reaction strategy was designed to synthesize the fusion genes for the proposed fusion proteins. The primers used in the PCR reactions are listed in Table 12, below.

TABLE 12

| Primer Name | Sequence (5' to 3') |
|---|---|
| IFNa14_Inner | GCCCTGGTGGTGCTGAGCTGCAAGAGCAGC-TGCAGCCTGGGCTGCGACCTGCCCCAGACCCACAGC (SEQ ID NO:1350) |
| IFNa14_Outer | TATAAAGCTTGCCACCATGGCCCTGCCCTTC-GCCCTGATGATGGCCCTGGTGGTGCTGAGCTGCAAG (SEQ ID NO:1351) |
| IFNb_Inner | GCCCTGCTGCTGTGCTTCAGCACCACCGCCC-TGAGCATGAGCTGCGACCTGCCCCAGACCCACAGC (SEQ ID NO:1352) |

TABLE 12-continued

| Primer Name | Sequence (5' to 3') |
|---|---|
| IFNb_Outer | TATAAAGCTTGCCACCATGACCAACAAGTGC-CTGCTGCAGATCGCCCTGCTGCTGTGCTTCAGCACC (SEQ ID NO:1353) |
| INFERGEN_End | TATAGAATTCTCATTACTCCTTGCGGCGCAGGCG (SEQ ID NO:1354) |

The mammalian Infergen gene was synthesized and cloned into pcDNA3.1 (Invitrogen, Carlsbad, Calif.) plasmid and was used as template. For the first round PCR to generate fusion Infergen gene with human Interferon Alpha 14 signal peptide, IFNa14_Inner primer was combined with INFERGEN_End primer to generate PCR templates for second round PCR that was carried out using IFNa14_Outer primer in combination with INFERGEN_END primer. The final PCR product was digested with both Hind III and EcoRI and cloned into predigested pcDNA3.1 vector. The same procedure was applied to generate Infergen gene with human Interferon Beta signal peptide except that IFNb_Inner and Outer primers were used to replace IFNa14_Inner and Outer primers, respectively.

Transient Transfection and Western Analysis

The Cos-7 cell line was selected to transiently over-express Infergen. Fugene-6 (Roche Applied Science, Indianapolis, Ind.) was used as the transfection reagent and the manufacturer's protocol was followed. Three days after the transfection, conditioned media was collected, then filtered through 0.22 µM Tissue Culture Filter Unit and concentrated with Centriplus YM-10 Centrifugal Filter Unit (Millipore, Billerica, Mass.). Protein concentrations were measured. The attached cells were collected and cell lysate made using conventional methods. Rabbit polyclonal antibodies made against E. coli over-expressed Infergen were used as primary antibodies in Western analysis.

Site-directed Mutagenesis

The locations of exemplary glycosylation sites in the two fusion Infergen proteins are shown in FIG. 25. The QuikChange site-directed mutagenesis kit (Stratagene, La Jolla, Calif.) was used to generate these mutations.

Results

The fusion constructs were generated and the sequences confirmed. FIG. 30 depicts an amino acid sequence alignment of Infergen (SEQ ID NO: 1356), human IFN-α14 (SEQ ID NO:1358), human IFN-α1 (SEQ ID NO:1359), and exemplary fusion proteins with human IFN-α14 and human IFN-β signal peptides (SEQ ID NOs:1388 and 1389, respectively). The majority sequence is shown above (SEQ ID NO:1387).

The constructs were then transiently transfected into Cos-7 cells and the transfection results were analyzed with western blot using rabbit polyclonal antibodies against Infergen. The results are shown in FIG. 32.

Figure 32:
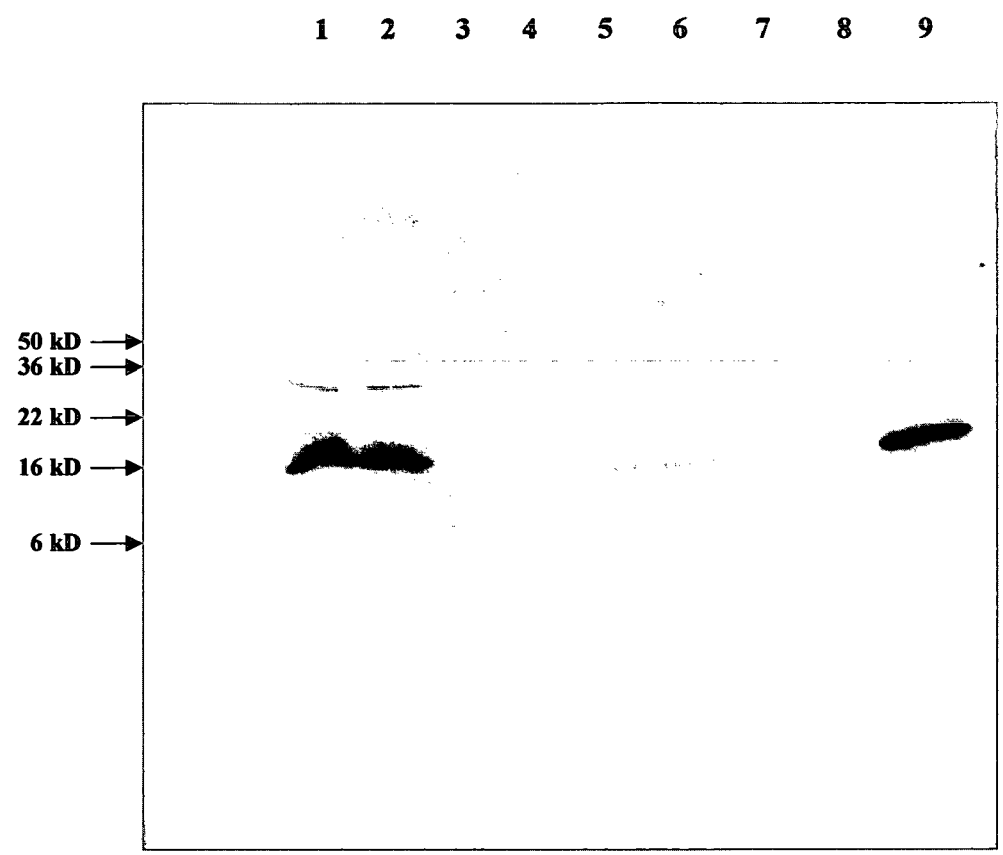
FIG. 32 depicts Western blot analysis of exemplary proteins synthesized by Cos-7 cells.

FIG. 32 depicts Western blot analysis of the transient transfection results. Lanes 1-4 were loaded with conditioned media from Cos-7 cells transfected with a plasmid containing nucleotide sequences encoding: Infergen with IFN-α14 signal peptide (lane 1); Infergen with IFN-β signal peptide (lane 2); Infergen without signal peptide (lane 3); and β-galactosidase (lane 4). Lanes 5-8 were loaded with cell lysates of Cos-7 cells transfected with plasmids a plasmid containing nucleotide sequences encoding: Infergen with IFN-α14 signal peptide (lane 5); Infergen with IFN-β signal peptide (lane 6); Infergen without signal peptide (lane 7); and β-galactosidase (lane 8). Lane 9 was loaded with 30 ng of Infergen, produced by E. coli and obtained from a commercial source.

The results showed that both fusion proteins expressed well and were mostly secreted by the cells into the conditioned media, while the Infergen without signal peptide expressed poorly and existed intracellularly. The two fusion genes were selected as templates for generation of glycosylation sites.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (2153 sequences)

SEQ ID NO: 1 - protein, 165 aa, Homo sapiens [sequence omitted]

SEQ ID NO: 2 - protein, 165 aa, Artificial Sequence
  D2A Mutant IFN-alpha 2b
CALPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 3 - protein, 165 aa, Artificial Sequence
  P4A Mutant IFN-alpha 2b
CDLAQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 4 - protein, 165 aa, Artificial Sequence
  Q5A Mutant IFN-alpha 2b
CDLPATHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 5 - protein, 165 aa, Artificial Sequence
  T6A Mutant IFN-alpha 2b
CDLPQAHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 6 - protein, 165 aa, Artificial Sequence
  H7A Mutant IFN-alpha 2b
CDLPQTASLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 7 - protein, 165 aa, Artificial Sequence
  S8A Mutant IFN-alpha 2b
CDLPQTHALGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 8 - protein, 165 aa, Artificial Sequence
  L9A Mutant IFN-alpha 2b
CDLPQTHSAGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 9 - protein, 165 aa, Artificial Sequence
  G10A Mutant IFN-alpha 2b
CDLPQTHSLASRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 10 - protein, 165 aa, Artificial Sequence
  S11A Mutant IFN-alpha 2b
CDLPQTHSLGARRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 11 - protein, 165 aa, Artificial Sequence
  R12A Mutant IFN-alpha 2b
CDLPQTHSLGSARTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 12 - protein, 165 aa, Artificial Sequence
  R13A Mutant IFN-alpha 2b
CDLPQTHSLGSRATLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 13 - protein, 165 aa, Artificial Sequence
  T14A Mutant IFN-alpha 2b
CDLPQTHSLGSRRALMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 14 - protein, 165 aa, Artificial Sequence
  L15A Mutant IFN-alpha 2b
CDLPQTHSLGSRRTAMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 15 - protein, 165 aa, Artificial Sequence
  M16A Mutant IFN-alpha 2b
CDLPQTHSLGSRRTLALLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 16 - protein, 165 aa, Artificial Sequence
  L17A Mutant IFN-alpha 2b
CDLPQTHSLGSRRTLMALAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 17 - protein, 165 aa, Artificial Sequence
  Q20A Mutant IFN-alpha 2b
CDLPQTHSLGSRRTLMLLAAMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 18 - protein, 165 aa, Artificial Sequence
  R23A Mutant IFN-alpha 2b
CDLPQTHSLGSRRTLMLLAQMRAISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 19 - protein, 165 aa, Artificial Sequence
  I24A Mutant IFN-alpha 2b
CDLPQTHSLGSRRTLMLLAQMRRASLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 20 - protein, 165 aa, Artificial Sequence
  S25A Mutant IFN-alpha 2b
CDLPQTHSLGSRRTLMLLAQMRRIALFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 21 - protein, 165 aa, Artificial Sequence
  L26A Mutant IFN-alpha 2b
CDLPQTHSLGSRRTLMLLAQMRRISAFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 22 - protein, 165 aa, Artificial Sequence
  S28A Mutant IFN-alpha 2b
CDLPQTHSLGSRRTLMLLAQMRRISLFACLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 23 - protein, 165 aa, Artificial Sequence
  C29A Mutant IFN-alpha 2b
CDLPQTHSLGSRRTLMLLAQMRRISLFSALKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 24 - protein, 165 aa, Artificial Sequence
  L30A Mutant IFN-alpha 2b
CDLPQTHSLGSRRTLMLLAQMRRISLFSCAKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 25 - protein, 165 aa, Artificial Sequence
  K31A Mutant IFN-alpha 2b
CDLPQTHSLGSRRTLMLLAQMRRISLFSCLADRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 26 - protein, 165 aa, Artificial Sequence
  D32A Mutant IFN-alpha 2b
CDLPQTHSLGSRRTLMLLAQMRRISLFSCLKARHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 27 - protein, 165 aa, Artificial Sequence
  R33A Mutant IFN-alpha 2b
CDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 28 - protein, 165 aa, Artificial Sequence
  D35A Mutant IFN-alpha 2b
CDLPQTHSLGSRRTLMLLAQMRRISLFSCLKDRHAFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 29 - protein, 165 aa, Artificial Sequence
  G37A Mutant IFN-alpha 2b
CDLPQTHSLGSRRTLMLLAQMRRISLFSCLKDRHDFAFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 30 - protein, 165 aa, Artificial Sequence
  P39A Mutant IFN-alpha 2b
CDLPQTHSLGSRRTLMLLAQMRRISLFSCLKDRHDFGFAQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 31 - protein, 165 aa, Artificial Sequence
  E41A Mutant IFN-alpha 2b
CDLPQTHSLGSRRTLMLLAQMRRISLFSCLKDRHDFGFPQAEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 32 - protein, 165 aa, Artificial Sequence
  E42A Mutant IFN-alpha 2b
CDLPQTHSLGSRRTLMLLAQMRRISLFSCLKDRHDFGFPQEAFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 33 - protein, 165 aa, Artificial Sequence
  F43A Mutant IFN-alpha 2b
CDLPQTHSLGSRRTLMLLAQMRRISLFSCLKDRHDFGFPQEEAGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 34 - protein, 165 aa, Artificial Sequence
  N45A Mutant IFN-alpha 2b
CDLPQTHSLGSRRTLMLLAQMRRISLFSCLKDRHDFGFPQEEFGAQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 35 - protein, 165 aa, Artificial Sequence
  F47A Mutant IFN-alpha 2b
CDLPQTHSLGSRRTLMLLAQMRRISLFSCLKDRHDFGFPQEEFGNQAQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 36 - protein, 165 aa, Artificial Sequence
  E51A Mutant IFN-alpha 2b
CDLPQTHSLGSRRTLMLLAQMRRISLFSCLKDRHDFGFPQEEFGNQFQKAATIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 37 - protein, 165 aa, Artificial Sequence
  T52A Mutant IFN-alpha 2b
CDLPQTHSLGSRRTLMLLAQMRRISLFSCLKDRHDFGFPQEEFGNQFQKAEAIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 38 - protein, 165 aa, Artificial Sequence
  I53A Mutant IFN-alpha 2b
CDLPQTHSLGSRRTLMLLAQMRRISLFSCLKDRHDFGFPQEEFGNQFQKAETAPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 39 - protein, 165 aa, Artificial Sequence
  P54A Mutant IFN-alpha 2b
CDLPQTHSLGSRRTLMLLAQMRRISLFSCLKDRHDFGFPQEEFGNQFQKAETIAVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 40 - protein, 165 aa, Artificial Sequence
  V55A Mutant IFN-alpha 2b
CDLPQTHSLGSRRTLMLLAQMRRISLFSCLKDRHDFGFPQEEFGNQFQKAETIPALHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 41 - protein, 165 aa, Artificial Sequence
  L56A Mutant IFN-alpha 2b
CDLPQTHSLGSRRTLMLLAQMRRISLFSCLKDRHDFGFPQEEFGNQFQKAETIPVAHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 42 - protein, 165 aa, Artificial Sequence
  H57A Mutant IFN-alpha 2b
CDLPQTHSLGSRRTLMLLAQMRRISLFSCLKDRHDFGFPQEEFGNQFQKAETIPVLAEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 43 - protein, 165 aa, Artificial Sequence
  E58A Mutant IFN-alpha 2b
CDLPQTHSLGSRRTLMLLAQMRRISLFSCLKDRHDFGFPQEEFGNQFQKAETIPVLHAMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 44 - protein, 165 aa, Artificial Sequence
  M59A Mutant IFN-alpha 2b
CDLPQTHSLGSRRTLMLLAQMRRISLFSCLKDRHDFGFPQEEFGNQFQKAETIPVLHEAIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 45 - protein, 165 aa, Artificial Sequence
  I60A Mutant IFN-alpha 2b
CDLPQTHSLGSRRTLMLLAQMRRISLFSCLKDRHDFGFPQEEFGNQFQKAETIPVLHEMAQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 46 - protein, 165 aa, Artificial Sequence
  I63A Mutant IFN-alpha 2b
CDLPQTHSLGSRRTLMLLAQMRRISLFSCLKDRHDFGFPQEEFGNQFQKAETIPVLHEMIQQAFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 47 - protein, 165 aa, Artificial Sequence
  F64A Mutant IFN-alpha 2b
CDLPQTHSLGSRRTLMLLAQMRRISLFSCLKDRHDFGFPQEEFGNQFQKAETIPVLHEMIQQIANLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 48 - protein, 165 aa, Artificial Sequence
  N65A Mutant IFN-alpha 2b
CDLPQTHSLGSRRTLMLLAQMRRISLFSCLKDRHDFGFPQEEFGNQFQKAETIPVLHEMIQQIFALFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 49 - protein, 165 aa, Artificial Sequence
  L66A Mutant IFN-alpha 2b
CDLPQTHSLGSRRTLMLLAQMRRISLFSCLKDRHDFGFPQEEFGNQFQKAETIPVLHEMIQQIFNAFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 50 - protein, 165 aa, Artificial Sequence
  F67A Mutant IFN-alpha 2b
CDLPQTHSLGSRRTLMLLAQMRRISLFSCLKDRHDFGFPQEEFGNQFQKAETIPVLHEMIQQIFNLASTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 51 - protein, 165 aa, Artificial Sequence
  T69A Mutant IFN-alpha 2b
CDLPQTHSLGSRRTLMLLAQMRRISLFSCLKDRHDFGFPQEEFGNQFQKAETIPVLHEMIQQIFNLFSAKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 52 - protein, 165 aa, Artificial Sequence
  K70A Mutant IFN-alpha 2b
CDLPQTHSLGSRRTLMLLAQMRRISLFSCLKDRHDFGFPQEEFGNQFQKAETIPVLHEMIQQIFNLFSTADSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 53 - protein, 165 aa, Artificial Sequence
  D71A Mutant IFN-alpha 2b
CDLPQTHSLGSRRTLMLLAQMRRISLFSCLKDRHDFGFPQEEFGNQFQKAETIPVLHEMIQQIFNLFSTKASSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 54 - protein, 165 aa, Artificial Sequence
  S72A Mutant IFN-alpha 2b
CDLPQTHSLGSRRTLMLLAQMRRISLFSCLKDRHDFGFPQEEFGNQFQKAETIPVLHEMIQQIFNLFSTKDASAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 55 - protein, 165 aa, Artificial Sequence
  W76A Mutant IFN-alpha 2b
CDLPQTHSLGSRRTLMLLAQMRRISLFSCLKDRHDFGFPQEEFGNQFQKAETIPVLHEMIQQIFNLFSTKDSSAAADETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 56 - protein, 165 aa, Artificial Sequence
  D77A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWAETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 57 - protein, 165 aa, Artificial Sequence
  E78A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDATLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 58 - protein, 165 aa, Artificial Sequence
  L81A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLADKFYTELYQQLNDLEACVIQGVGVTETPLMKEDSILAVRKYFQRITLYLKEKKYSPCAWEVVRAEIMRSFSLSTNLQESLRSKE

SEQ ID NO: 59 - protein, 165 aa, Artificial Sequence
  D82A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLAKFYTELYQQLNDLEACVIQGVGVTETPLMKEDSILAVRKYFQRITLYLKEKKYSPCAWEVVRAEIMRSFSLSTNLQESLRSKE

SEQ ID NO: 60 - protein, 165 aa, Artificial Sequence
  K83A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDAFYTELYQQLNDLEACVIQGVGVTETPLMKEDSILAVRKYFQRITLYLKEKKYSPCAWEVVRAEIMRSFSLSTNLQESLRSKE

SEQ ID NO: 61 - protein, 165 aa, Artificial Sequence
  F84A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKAYTELYQQLNDLEACVIQGVGVTETPLMKEDSILAVRKYFQRITLYLKEKKYSPCAWEVVRAEIMRSFSLSTNLQESLRSKE

SEQ ID NO: 62 - protein, 165 aa, Artificial Sequence
  Y85A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFATELYQQLNDLEACVIQGVGVTETPLMKEDSILAVRKYFQRITLYLKEKKYSPCAWEVVRAEIMRSFSLSTNLQESLRSKE

SEQ ID NO: 63 - protein, 165 aa, Artificial Sequence
  Y89A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELAQQLNDLEACVIQGVGVTETPLMKEDSILAVRKYFQRITLYLKEKKYSPCAWEVVRAEIMRSFSLSTNLQESLRSKE

SEQ ID NO: 64 - protein, 165 aa, Artificial Sequence
  Q90A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYAQLNDLEACVIQGVGVTETPLMKEDSILAVRKYFQRITLYLKEKKYSPCAWEVVRAEIMRSFSLSTNLQESLRSKE

SEQ ID NO: 65 - protein, 165 aa, Artificial Sequence
  Q91A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQALNDLEACVIQGVGVTETPLMKEDSILAVRKYFQRITLYLKEKKYSPCAWEVVRAEIMRSFSLSTNLQESLRSKE

SEQ ID NO: 66 - protein, 165 aa, Artificial Sequence
  N93A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLADLEACVIQGVGVTETPLMKEDSILAVRKYFQRITLYLKEKKYSPCAWEVVRAEIMRSFSLSTNLQESLRSKE

SEQ ID NO: 67 - protein, 165 aa, Artificial Sequence
  D94A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNALEACVIQGVGVTETPLMKEDSILAVRKYFQRITLYLKEKKYSPCAWEVVRAEIMRSFSLSTNLQESLRSKE

SEQ ID NO: 68 - protein, 165 aa, Artificial Sequence
  C98A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEAAVIQGVGVTETPLMKEDSILAVRKYFQRITLYLKEKKYSPCAWEVVRAEIMRSFSLSTNLQESLRSKE

SEQ ID NO: 69 - protein, 165 aa, Artificial Sequence
  V99A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACAIQGVGVTETPLMKEDSILAVRKYFQRITLYLKEKKYSPCAWEVVRAEIMRSFSLSTNLQESLRSKE

SEQ ID NO: 70 - protein, 165 aa, Artificial Sequence
  G104A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVAVTETPLMKEDSILAVRKYFQRITLYLKEKKYSPCAWEVVRAEIMRSFSLSTNLQESLRSKE

SEQ ID NO: 71 - protein, 165 aa, Artificial Sequence
  L110A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPAMKEDSILAVRKYFQRITLYLKEKKYSPCAWEVVRAEIMRSFSLSTNLQESLRSKE

SEQ ID NO: 72 - protein, 165 aa, Artificial Sequence
  S115A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDAILAVRKYFQRITLYLKEKKYSPCAWEVVRAEIMRSFSLSTNLQESLRSKE

SEQ ID NO: 73 - protein, 165 aa, Artificial Sequence
  Y122A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKAFQRITLYLKEKKYSPCAWEVVRAEIMRSFSLSTNLQESLRSKE

SEQ ID NO: 74 - protein, 165 aa, Artificial Sequence
  W140A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAAEVVRAEIMRSFSLSTNLQESLRSKE

SEQ ID NO: 75 - protein, 165 aa, Artificial Sequence
  E146A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAAIMRSFSLSTNLQESLRSKE

SEQ ID NO: 76 - protein, 165 aa, Artificial Sequence
  L3V Mutant IFN-alpha 2b
CDVPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 77 - protein, 165 aa, Artificial Sequence
  R12H Mutant IFN-alpha 2b
CDLPQTHSLGSHRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 78 - protein, 165 aa, Artificial Sequence
  R13H Mutant IFN-alpha 2b
CDLPQTHSLGSRHTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 79 - protein, 165 aa, Artificial Sequence
  M16V Mutant IFN-alpha 2b
CDLPQTHSLGSRRTLVLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 80 - protein, 165 aa, Artificial Sequence
  M16I Mutant IFN-alpha 2b
CDLPQTHSLGSRRTLILLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 81 - protein, 165 aa, Artificial Sequence
  R22H Mutant IFN-alpha 2b
CDLPQTHSLGSRRTLMLLAQMHRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 82 - protein, 165 aa, Artificial Sequence
  F27I Mutant IFN-alpha 2b
CDLPQTHSLGSRRTLMLLAQMRRISLISCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 83 - protein, 165 aa, Artificial Sequence
  F27V Mutant IFN-alpha 2b
CDLPQTHSLGSRRTLMLLAQMRRISLVSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 84 - protein, 165 aa, Artificial Sequence
  L30I Mutant IFN-alpha 2b
CDLPQTHSLGSRRTLMLLAQMRRISLFSCIKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 85 - protein, 165 aa, Artificial Sequence
  K31Q Mutant IFN-alpha 2b
CDLPQTHSLGSRRTLMLLAQMRRISLFSCLQDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 86 - protein, 165 aa, Artificial Sequence
  R33H Mutant IFN-alpha 2b
CDLPQTHSLGSRRTLMLLAQMRRISLFSCLKDHHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 87 - protein, 165 aa, Artificial Sequence
  E41Q Mutant IFN-alpha 2b
CDLPQTHSLGSRRTLMLLAQMRRISLFSCLKDRHDFGFPQQEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 88 - protein, 165 aa, Artificial Sequence
  E41H Mutant IFN-alpha 2b
CDLPQTHSLGSRRTLMLLAQMRRISLFSCLKDRHDFGFPQHEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 89 - protein, 165 aa, Artificial Sequence
  E58Q Mutant IFN-alpha 2b
CDLPQTHSLGSRRTLMLLAQMRRISLFSCLKDRHDFGFPQEEFGNQFQKAETIPVLHQMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 90 - protein, 165 aa, Artificial Sequence
  E58H Mutant IFN-alpha 2b
CDLPQTHSLGSRRTLMLLAQMRRISLFSCLKDRHDFGFPQEEFGNQFQKAETIPVLHHMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 91 - protein, 165 aa, Artificial Sequence
  K70T Mutant IFN-alpha 2b
CDLPQTHSLGSRRTLMLLAQMRRISLFSCLKDRHDFGFPQEEFGNQFQKAETIPVLHEMIQQIFNLFSTTDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 92 - protein, 165 aa, Artificial Sequence
  E78Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDQTLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 93 - protein, 165 aa, Artificial Sequence
  E78H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDHTLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 94 - protein, 165 aa, Artificial Sequence
  Y89I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELIQQLNDLEACVIQGVGVTETPLMKEDSILAVRKYFQRITLYLKEKKYSPCAWEVVRAEIMRSFSLSTNLQESLRSKE

SEQ ID NO: 95 - protein, 165 aa, Artificial Sequence
  E107Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTQTPLMKEDSILAVRKYFQRITLYLKEKKYSPCAWEVVRAEIMRSFSLSTNLQESLRSKE

SEQ ID NO: 96 - protein, 165 aa, Artificial Sequence
  E107H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTHTPLMKEDSILAVRKYFQRITLYLKEKKYSPCAWEVVRAEIMRSFSLSTNLQESLRSKE

SEQ ID NO: 97 - protein, 165 aa, Artificial Sequence
  P109A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETALMKEDSILAVRKYFQRITLYLKEKKYSPCAWEVVRAEIMRSFSLSTNLQESLRSKE

SEQ ID NO: 98 - protein, 165 aa, Artificial Sequence
  L110V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPVMKEDSILAVRKYFQRITLYLKEKKYSPCAWEVVRAEIMRSFSLSTNLQESLRSKE

SEQ ID NO: 99 - protein, 165 aa, Artificial Sequence
  M111I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLIKEDSILAVRKYFQRITLYLKEKKYSPCAWEVVRAEIMRSFSLSTNLQESLRSKE

SEQ ID NO: 100 - protein, 165 aa, Artificial Sequence
  E113Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKQDSILAVRKYFQRITLYLKEKKYSPCAWEVVRAEIMRSFSLSTNLQESLRSKE

SEQ ID NO: 101 - protein, 165 aa, Artificial Sequence
  E113H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKHDSILAVRKYFQRITLYLKEKKYSPCAWEVVRAEIMRSFSLSTNLQESLRSKE

SEQ ID NO: 102 - protein, 165 aa, Artificial Sequence
  L117V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIVAVRKYFQRITLYLKEKKYSPCAWEVVRAEIMRSFSLSTNLQESLRSKE

SEQ ID NO: 103 - protein, 165 aa, Artificial Sequence
  L117I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIIAVRKYFQRITLYLKEKKYSPCAWEVVRAEIMRSFSLSTNLQESLRSKE

SEQ ID NO: 104 - protein, 165 aa, Artificial Sequence
  K121Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRQYFQRITLYLKEKKYSPCAWEVVRAEIMRSFSLSTNLQESLRSKE

SEQ ID NO: 105 - protein, 165 aa, Artificial Sequence
  K121T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRTYFQRITLYLKEKKYSPCAWEVVRAEIMRSFSLSTNLQESLRSKE

SEQ ID NO: 106 - protein, 165 aa, Artificial Sequence
  R125H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQHITLYLKEKKYSPCAWEVVRAEIMRSFSLSTNLQESLRSKE

SEQ ID NO: 107 - protein, 165 aa, Artificial Sequence
  R125Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQQITLYLKEKKYSPCAWEVVRAEIMRSFSLSTNLQESLRSKE

SEQ ID NO: 108 - protein, 165 aa, Artificial Sequence
  L128V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITVYLKEKKYSPCAWEVVRAEIMRSFSLSTNLQESLRSKE

SEQ ID NO: 109 - protein, 165 aa, Artificial Sequence
  L128I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITIYLKEKKYSPCAWEVVRAEIMRSFSLSTNLQESLRSKE

SEQ ID NO: 110 - protein, 165 aa, Artificial Sequence
  K131Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLQEKKYSPCAWEVVRAEIMRSFSLSTNLQESLRSKE

SEQ ID NO: 111 - protein, 165 aa, Artificial Sequence
  K131T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLTEKKYSPCAWEVVRAEIMRSFSLSTNLQESLRSKE

SEQ ID NO: 112 - protein, 165 aa, Artificial Sequence
  E132Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKQKKYSPCAWEVVRAEIMRSFSLSTNLQESLRSKE

SEQ ID NO: 113 - protein, 165 aa, Artificial Sequence
  E132H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKHKKYSPCAWEVVRAEIMRSFSLSTNLQESLRSKE

SEQ ID NO: 114 - protein, 165 aa, Artificial Sequence
  K133Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEQKYSPCAWEVVRAEIMRSFSLSTNLQESLRSKE

SEQ ID NO: 115 - protein, 165 aa, Artificial Sequence
  K133T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKETKYSPCAWEVVRAEIMRSFSLSTNLQESLRSKE

SEQ ID NO: 116 - protein, 165 aa, Artificial Sequence
  K134Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKQYSPCAWEVVRAEIMRSFSLSTNLQESLRSKE

SEQ ID NO: 117 - protein, 165 aa, Artificial Sequence
  Y135H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKHSPCAWEVVRAEIMRSFSLSTNLQESLRSKE

SEQ ID NO: 118 - protein, 165 aa, Artificial Sequence
  Y135I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKISPCAWEVVRAEIMRSFSLSTNLQESLRSKE

SEQ ID NO: 119 - protein, 165 aa, Artificial Sequence
  P137A Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSACAWEVVRAEIMRSFSLSTNLQESLRSKE

SEQ ID NO: 120 - protein, 165 aa, Artificial Sequence
  M148V Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIVRSFSLSTNLQESLRSKE

SEQ ID NO: 121 - protein, 165 aa, Artificial Sequence
  M148I Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIIRSFSLSTNLQESLRSKE

SEQ ID NO: 122 - protein, 165 aa, Artificial Sequence
  R149H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMHSFSLSTNLQESLRSKE

SEQ ID NO: 123 - protein, 165 aa, Artificial Sequence
  R149Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMQSFSLSTNLQESLRSKE

SEQ ID NO: 124 - protein, 165 aa, Artificial Sequence
  E159Q Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQQSLRSKE

SEQ ID NO: 125 - protein, 165 aa, Artificial Sequence
  E159H Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQHSLRSKE

SEQ ID NO: 126 - protein, 165 aa, Artificial Sequence
  P4S Mutant IFN-alpha 2b
CDLSQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 127 - protein, 165 aa, Artificial Sequence
  Q5N/H7S Mutant IFN-alpha 2b
CDLPNTSSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 128 - protein, 165 aa, Artificial Sequence
  Q5N/H7T Mutant IFN-alpha 2b
CDLPNTTSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 129 - protein, 165 aa, Artificial Sequence
  T6N/S8S Mutant IFN-alpha 2b
CDLPQNHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 130 - protein, 165 aa, Artificial Sequence
  S8N/G10S Mutant IFN-alpha 2b
CDLPQTHNLSSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 131 - protein, 165 aa, Artificial Sequence
  S8N/G10T Mutant IFN-alpha 2b
CDLPQTHNLTSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 132 - protein, 165 aa, Artificial Sequence
  M21N/R23S Mutant IFN-alpha 2b
CDLPQTHSLGSRRTLMLLAQNRSISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 133 - protein, 165 aa, Artificial Sequence
  R23N/S25T Mutant IFN-alpha 2b
CDLPQTHSLGSRRTLMLLAQMRNITLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 134 - protein, 165 aa, Artificial Sequence
  I24N/L26S Mutant IFN-alpha 2b
CDLPQTHSLGSRRTLMLLAQMRRNSSFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 135 - protein, 165 aa, Artificial Sequence
  S25N/F27S Mutant IFN-alpha 2b
CDLPQTHSLGSRRTLMLLAQMRRINLSSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 136 - protein, 165 aa, Artificial Sequence
  S25N/F27T Mutant IFN-alpha 2b
CDLPQTHSLGSRRTLMLLAQMRRINLTSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 137 - protein, 165 aa, Artificial Sequence
  L26N/S28S Mutant IFN-alpha 2b
CDLPQTHSLGSRRTLMLLAQMRRISNFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 138 - protein, 165 aa, Artificial Sequence
  L26N/S28T Mutant IFN-alpha 2b
CDLPQTHSLGSRRTLMLLAQMRRISNFTCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 139 - protein, 165 aa, Artificial Sequence
  L30N/D32S Mutant IFN-alpha 2b
CDLPQTHSLGSRRTLMLLAQMRRISLFSCNKSRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 140 - protein, 165 aa, Artificial Sequence
  R33N/D35S Mutant IFN-alpha 2b
CDLPQTHSLGSRRTLMLLAQMRRISLFSCLKDNHSFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 141 - protein, 165 aa, Artificial Sequence
  R33N/D35T Mutant IFN-alpha 2b
CDLPQTHSLGSRRTLMLLAQMRRISLFSCLKDNHTFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 142 - protein, 165 aa, Artificial Sequence
  H34N/F36S Mutant IFN-alpha 2b
CDLPQTHSLGSRRTLMLLAQMRRISLFSCLKDRNDSGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 143 - protein, 165 aa, Artificial Sequence
  H34N/F36T Mutant IFN-alpha 2b
CDLPQTHSLGSRRTLMLLAQMRRISLFSCLKDRNDTGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 144 - protein, 165 aa, Artificial Sequence
  D35N/G37S Mutant IFN-alpha 2b
CDLPQTHSLGSRRTLMLLAQMRRISLFSCLKDRHNFSFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 145 - protein, 165 aa, Artificial Sequence
  F36N/F38S Mutant IFN-alpha 2b
CDLPQTHSLGSRRTLMLLAQMRRISLFSCLKDRHDNGSPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 146 - protein, 165 aa, Artificial Sequence
  F36N/F38T Mutant IFN-alpha 2b
CDLPQTHSLGSRRTLMLLAQMRRISLFSCLKDRHDNGTPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 147 - protein, 165 aa, Artificial Sequence
  G37N/P39T Mutant IFN-alpha 2b
CDLPQTHSLGSRRTLMLLAQMRRISLFSCLKDRHDFNFTQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 148 - protein, 165 aa, Artificial Sequence
  F38N/Q40S Mutant IFN-alpha 2b
CDLPQTHSLGSRRTLMLLAQMRRISLFSCLKDRHDFGNPSEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 149 - protein, 165 aa, Artificial Sequence
  F38N/Q40T Mutant IFN-alpha 2b
CDLPQTHSLGSRRTLMLLAQMRRISLFSCLKDRHDFGNPTEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 150 - protein, 165 aa, Artificial Sequence
  P39N/E41S Mutant IFN-alpha 2b
CDLPQTHSLGSRRTLMLLAQMRRISLFSCLKDRHDFGFNQSEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 151 - protein, 165 aa, Artificial Sequence
  P39N/E41T Mutant IFN-alpha 2b
CDLPQTHSLGSRRTLMLLAQMRRISLFSCLKDRHDFGFNQTEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 152 - protein, 165 aa, Artificial Sequence
  Q40N/E42S Mutant IFN-alpha 2b
CDLPQTHSLGSRRTLMLLAQMRRISLFSCLKDRHDFGFPNESFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 153 - protein, 165 aa, Artificial Sequence
  Q40N/E42T Mutant IFN-alpha 2b
CDLPQTHSLGSRRTLMLLAQMRRISLFSCLKDRHDFGFPNETFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 154 - protein, 165 aa, Artificial Sequence
  E41N/F43S Mutant IFN-alpha 2b
CDLPQTHSLGSRRTLMLLAQMRRISLFSCLKDRHDFGFPQNESGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 155 - protein, 165 aa, Artificial Sequence
  E41N/F43T Mutant IFN-alpha 2b
CDLPQTHSLGSRRTLMLLAQMRRISLFSCLKDRHDFGFPQNETGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 156 - protein, 165 aa, Artificial Sequence
  G44N/Q46S Mutant IFN-alpha 2b
CDLPQTHSLGSRRTLMLLAQMRRISLFSCLKDRHDFGFPQEEFNNSFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 157 - protein, 165 aa, Artificial Sequence
  G44N/Q46T Mutant IFN-alpha 2b
CDLPQTHSLGSRRTLMLLAQMRRISLFSCLKDRHDFGFPQEEFNNTFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 158 - protein, 165 aa, Artificial Sequence
  N45N/F47S Mutant IFN-alpha 2b
CDLPQTHSLGSRRTLMLLAQMRRISLFSCLKDRHDFGFPQEEFGNQSQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 159 - protein, 165 aa, Artificial Sequence
  N45N/F47T Mutant IFN-alpha 2b
CDLPQTHSLGSRRTLMLLAQMRRISLFSCLKDRHDFGFPQEEFGNQTQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 160 - protein, 165 aa, Artificial Sequence
  Q46N/Q48S Mutant IFN-alpha 2b
CDLPQTHSLGSRRTLMLLAQMRRISLFSCLKDRHDFGFPQEEFGNNFSKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 161 - protein, 165 aa, Artificial Sequence
  Q46N/Q48T Mutant IFN-alpha 2b
CDLPQTHSLGSRRTLMLLAQMRRISLFSCLKDRHDFGFPQEEFGNNFTKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 162 - protein, 165 aa, Artificial Sequence
  F47N/K49S Mutant IFN-alpha 2b
CDLPQTHSLGSRRTLMLLAQMRRISLFSCLKDRHDFGFPQEEFGNQNQSAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 163 - protein, 165 aa, Artificial Sequence
  F47N/K49T Mutant IFN-alpha 2b
CDLPQTHSLGSRRTLMLLAQMRRISLFSCLKDRHDFGFPQEEFGNQNQTAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 164 - protein, 165 aa, Artificial Sequence
  K49N/E51S Mutant IFN-alpha 2b
CDLPQTHSLGSRRTLMLLAQMRRISLFSCLKDRHDFGFPQEEFGNQFQNASTIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 165 - protein, 165 aa, Artificial Sequence
  A75N/D77S Mutant IFN-alpha 2b
CDLPQTHSLGSRRTLMLLAQMRRISLFSCLKDRHDFGFPQEEFGNQFQKAETIPVLHEMIQQIFNLFSTKDSSANWSETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 166 - protein, 165 aa, Artificial Sequence
  I100N/G102S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVNQSVGVTETPLMKEDSILAVRKYFQRITLYLKEKKYSPCAWEVVRAEIMRSFSLSTNLQESLRSKE

SEQ ID NO: 167 - protein, 165 aa, Artificial Sequence
  I100N/G102T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVNQTVGVTETPLMKEDSILAVRKYFQRITLYLKEKKYSPCAWEVVRAEIMRSFSLSTNLQESLRSKE

SEQ ID NO: 168 - protein, 165 aa, Artificial Sequence
  V103N/V105S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGNGSTETPLMKEDSILAVRKYFQRITLYLKEKKYSPCAWEVVRAEIMRSFSLSTNLQESLRSKE

SEQ ID NO: 169 - protein, 165 aa, Artificial Sequence
  V103N/V105T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGNGTTETPLMKEDSILAVRKYFQRITLYLKEKKYSPCAWEVVRAEIMRSFSLSTNLQESLRSKE

SEQ ID NO: 170 - protein, 165 aa, Artificial Sequence
  G104N/T106T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVNVTETPLMKEDSILAVRKYFQRITLYLKEKKYSPCAWEVVRAEIMRSFSLSTNLQESLRSKE

SEQ ID NO: 171 - protein, 165 aa, Artificial Sequence
  V105N/E107S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGNTSTPLMKEDSILAVRKYFQRITLYLKEKKYSPCAWEVVRAEIMRSFSLSTNLQESLRSKE

SEQ ID NO: 172 - protein, 165 aa, Artificial Sequence
  T106N/T108S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVNESPLMKEDSILAVRKYFQRITLYLKEKKYSPCAWEVVRAEIMRSFSLSTNLQESLRSKE

SEQ ID NO: 173 - protein, 165 aa, Artificial Sequence
  T106N/T108T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVNETPLMKEDSILAVRKYFQRITLYLKEKKYSPCAWEVVRAEIMRSFSLSTNLQESLRSKE

SEQ ID NO: 174 - protein, 165 aa, Artificial Sequence
  E107N/P109S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTNTSLMKEDSILAVRKYFQRITLYLKEKKYSPCAWEVVRAEIMRSFSLSTNLQESLRSKE

SEQ ID NO: 175 - protein, 165 aa, Artificial Sequence
  E107N/P109T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTNTTLMKEDSILAVRKYFQRITLYLKEKKYSPCAWEVVRAEIMRSFSLSTNLQESLRSKE

SEQ ID NO: 176 - protein, 165 aa, Artificial Sequence
  K134N/S136T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKNYTPCAWEVVRAEIMRSFSLSTNLQESLRSKE

SEQ ID NO: 177 - protein, 165 aa, Artificial Sequence
  L157N/E159S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNNQSSLRSKE

SEQ ID NO: 178 - protein, 165 aa, Artificial Sequence
  L157N/E159T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNNQTSLRSKE

SEQ ID NO: 179 - protein, 165 aa, Artificial Sequence
  Q158N/S160T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLNETLRSKE

SEQ ID NO: 180 - protein, 165 aa, Artificial Sequence
  E159N/L161S Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQNSSRSKE

SEQ ID NO: 181 - protein, 165 aa, Artificial Sequence
  E159N/L161T Mutant IFN-alpha 2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQNSTRSKE

SEQ ID NO: 182 - protein, 165 aa, Homo sapiens
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 183 - protein, 166 aa, Homo sapiens
CDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 184 - skipped

SEQ ID NO: 185 - protein, 165 aa, Homo sapiens
CDLPQTHSLGSRRTLMLLAQMRRISLFSCLKDRRDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 186 - protein, 166 aa, Homo sapiens
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 187 - protein, 166 aa, Homo sapiens
CDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 188 - protein, 166 aa, Homo sapiens
CDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 189 - protein, 166 aa, Homo sapiens
CDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 190 - protein, 166 aa, Homo sapiens
CDLPQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 191 - protein, 166 aa, Homo sapiens
CDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 192 - protein, 166 aa, Homo sapiens
CDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 193 - protein, 166 aa, Homo sapiens
CNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 194 - protein, 166 aa, Homo sapiens
CDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 195 - protein, 166 aa, Homo sapiens
CDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 196 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 197 - protein, 166 aa, Homo sapiens; identical to SEQ ID NO: 196

SEQ ID NO: 198 - protein, 183 aa, Homo sapiens
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 199 - protein, 146 aa, Homo sapiens
CYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 200 - skipped

SEQ ID NO: 201 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 202 - protein, 127 aa, Homo sapiens [sequence omitted]

SEQ ID NO: 203-209 - skipped (7 entries)

SEQ ID NO: 210 - protein, 177 aa, Homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 211-231 - skipped (21 entries)

SEQ ID NO: 232 - protein, 165 aa, Artificial Sequence
  Interferon alpha consensus sequence
CDLPQTHSLGNRRALILLAQMRRISPFSCLKDRHDFGPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 233 - protein, 166 aa, Homo sapiens
MSYNLLGFLQRSSNFQCQKLLWQLNGRLEYCLKDRMNFQIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 234 - protein, 166 aa, Homo sapiens; identical to SEQ ID NO: 233

SEQ ID NO: 235 - protein, 166 aa, Homo sapiens
MSYNLLGFLQRSSNFQCQKLLWQLNGRLEYCLKDRMNFHIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 236 - protein, 166 aa, Homo sapiens
MSYNLLGFLQRSSNFQCQKLLWQLNGRLEYCLKDRMNFGIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 237 - protein, 166 aa, Homo sapiens
MSYNLLGFLQRSSNFQCQKLLWQLNGRLEYCLKDRMNFDIPQEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 238 - protein, 166 aa, Homo sapiens
MSYNLLGFLQRSSNFQCQKLLWQLNGRLEYCLKDRMNFDIPHEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 239 - protein, 166 aa, Homo sapiens
MSYNLLGFLQRSSNFQCQKLLWQLNGRLEYCLKDRMNFDIPEEIQQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 240 - protein, 166 aa, Homo sapiens
MSYNLLGFLQRSSNFQCQKLLWQLNGRLEYCLKDRMNFDIPEEITQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 241 - protein, 166 aa, Homo sapiens
MSYNLLGFLQRSSNFQCQKLLWQLNGRLEYCLKDRMNFDIPEEISQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 242 - protein, 166 aa, Homo sapiens
MSYNLLGFLQRSSNFQCQKLLWQLNGRLEYCLKDRMNFDIPEEIHQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 243 - protein, 166 aa, Homo sapiens
MSYNLLGFLQRSSNFQCQKLLWQLNGRLEYCLKDRMNFDIPEEIKQVQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 244 - protein, 166 aa, Homo sapiens
MSYNLLGFLQRSSNFQCQKLLWQLNGRLEYCLKDRMNFDIPEEIKQIQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 245 - protein, 166 aa, Homo sapiens
MSYNLLGFLQRSSNFQCQKLLWQLNGRLEYCLKDRMNFDIPEEIKQTQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 246 - protein, 166 aa, Homo sapiens
MSYNLLGFLQRSSNFQCQKLLWQLNGRLEYCLKDRMNFDIPEEIKQQQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 247 - protein, 166 aa, Homo sapiens
MSYNLLGFLQRSSNFQCQKLLWQLNGRLEYCLKDRMNFDIPEEIKQHQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 248 - protein, 166 aa, Homo sapiens
MSYNLLGFLQRSSNFQCQKLLWQLNGRLEYCLKDRMNFDIPEEIKQAQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 249 - protein, 166 aa, Homo sapiens
MSYNLLGFLQRSSNFQCQKLLWQLNGRLEYCLKDRMNFDIPEEIKQLQQFQQEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 250 - protein, 166 aa, Homo sapiens
MSYNLLGFLQRSSNFQCQKLLWQLNGRLEYCLKDRMNFDIPEEIKQLQQFQTEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 251 - protein, 166 aa, Homo sapiens
MSYNLLGFLQRSSNFQCQKLLWQLNGRLEYCLKDRMNFDIPEEIKQLQQFQSEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 252 - protein, 166 aa, Homo sapiens
MSYNLLGFLQRSSNFQCQKLLWQLNGRLEYCLKDRMNFDIPEEIKQLQQFQHEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 253 - protein, 166 aa, Homo sapiens
MSYNLLGFLQRSSNFQCQKLLWQLNGRLEYCLKDRMNFDIPEEIKQLQQFQKEDAALTIYEMLQNIIAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 254 - protein, 166 aa, Homo sapiens
MSYNLLGFLQRSSNFQCQKLLWQLNGRLEYCLKDRMNFDIPEEIKQLQQFQKEDAALTIYEMLQNIVAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 255 - protein, 166 aa, Homo sapiens
MSYNLLGFLQRSSNFQCQKLLWQLNGRLEYCLKDRMNFDIPEEIKQLQQFQKEDAALTIYEMLQNIFAIFHQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 256 - protein, 166 aa, Homo sapiens
MSYNLLGFLQRSSNFQCQKLLWQLNGRLEYCLKDRMNFDIPEEIKQLQQFQKEDAALTIYEMLQNIFAIFQQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 257 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQQSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 258 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQHSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 259 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQGSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 260 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNQTIVENLLANVYHQINHLKTVLEEKLEKEDFTRGKLMSSLHLKRYYGRILHYLKAKEYSHCAWTIVRVEILRNFYFINRLTGYLRN

SEQ ID NO: 261 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNHTIVENLLANVYHQINHLKTVLEEKLEKEDFTRGKLMSSLHLKRYYGRILHYLKAKEYSHCAWTIVRVEILRNFYFINRLTGYLRN

SEQ ID NO: 262 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLQKEDFTRGKLMSSLHLKRYYGRILHYLKAKEYSHCAWTIVRVEILRNFYFINRLTGYLRN

SEQ ID NO: 263 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLHKEDFTRGKLMSSLHLKRYYGRILHYLKAKEYSHCAWTIVRVEILRNFYFINRLTGYLRN

SEQ ID NO: 264 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEQEDFTRGKLMSSLHLKRYYGRILHYLKAKEYSHCAWTIVRVEILRNFYFINRLTGYLRN

SEQ ID NO: 265 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLETEDFTRGKLMSSLHLKRYYGRILHYLKAKEYSHCAWTIVRVEILRNFYFINRLTGYLRN

SEQ ID NO: 266 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLESEDFTRGKLMSSLHLKRYYGRILHYLKAKEYSHCAWTIVRVEILRNFYFINRLTGYLRN

SEQ ID NO: 267 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEHEDFTRGKLMSSLHLKRYYGRILHYLKAKEYSHCAWTIVRVEILRNFYFINRLTGYLRN

SEQ ID NO: 268 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKQDFTRGKLMSSLHLKRYYGRILHYLKAKEYSHCAWTIVRVEILRNFYFINRLTGYLRN

SEQ ID NO: 269 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKHDFTRGKLMSSLHLKRYYGRILHYLKAKEYSHCAWTIVRVEILRNFYFINRLTGYLRN

SEQ ID NO: 270 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEQFTRGKLMSSLHLKRYYGRILHYLKAKEYSHCAWTIVRVEILRNFYFINRLTGYLRN

SEQ ID NO: 271 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEHFTRGKLMSSLHLKRYYGRILHYLKAKEYSHCAWTIVRVEILRNFYFINRLTGYLRN

SEQ ID NO: 272 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEGFTRGKLMSSLHLKRYYGRILHYLKAKEYSHCAWTIVRVEILRNFYFINRLTGYLRN

SEQ ID NO: 273 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDITRGKLMSSLHLKRYYGRILHYLKAKEYSHCAWTIVRVEILRNFYFINRLTGYLRN

SEQ ID NO: 274 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDVTRGKLMSSLHLKRYYGRILHYLKAKEYSHCAWTIVRVEILRNFYFINRLTGYLRN

SEQ ID NO: 275 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTHGKLMSSLHLKRYYGRILHYLKAKEYSHCAWTIVRVEILRNFYFINRLTGYLRN

SEQ ID NO: 276 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTQGKLMSSLHLKRYYGRILHYLKAKEYSHCAWTIVRVEILRNFYFINRLTGYLRN

SEQ ID NO: 277 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKVMSSLHLKRYYGRILHYLKAKEYSHCAWTIVRVEILRNFYFINRLTGYLRN

SEQ ID NO: 278 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKIMSSLHLKRYYGRILHYLKAKEYSHCAWTIVRVEILRNFYFINRLTGYLRN

SEQ ID NO: 279 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKTMSSLHLKRYYGRILHYLKAKEYSHCAWTIVRVEILRNFYFINRLTGYLRN

SEQ ID NO: 280 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKQMSSLHLKRYYGRILHYLKAKEYSHCAWTIVRVEILRNFYFINRLTGYLRN

SEQ ID NO: 281 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKHMSSLHLKRYYGRILHYLKAKEYSHCAWTIVRVEILRNFYFINRLTGYLRN

SEQ ID NO: 282 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKAMSSLHLKRYYGRILHYLKAKEYSHCAWTIVRVEILRNFYFINRLTGYLRN

SEQ ID NO: 283 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSVHLKRYYGRILHYLKAKEYSHCAWTIVRVEILRNFYFINRLTGYLRN

SEQ ID NO: 284 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSIHLKRYYGRILHYLKAKEYSHCAWTIVRVEILRNFYFINRLTGYLRN

SEQ ID NO: 285 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSTHLKRYYGRILHYLKAKEYSHCAWTIVRVEILRNFYFINRLTGYLRN

SEQ ID NO: 286 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSQHLKRYYGRILHYLKAKEYSHCAWTIVRVEILRNFYFINRLTGYLRN

SEQ ID NO: 287 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSHHLKRYYGRILHYLKAKEYSHCAWTIVRVEILRNFYFINRLTGYLRN

SEQ ID NO: 288 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSAHLKRYYGRILHYLKAKEYSHCAWTIVRVEILRNFYFINRLTGYLRN

SEQ ID NO: 289 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLQRYYGRILHYLKAKEYSHCAWTIVRVEILRNFYFINRLTGYLRN

SEQ ID NO: 290 - protein, 100 aa, Homo sapiens
CYCQDPYVKEAENLKKYFNAGHSDVADNGTLFVGILKNWKEESDRKIMQSQIVSFYFKLFKNFKDDQSIQKSVETIKEDMNVKFFNSNKKKRDDFEKLTN

SEQ ID NO: 291 - protein, 100 aa, Homo sapiens
CYCQDPYVKEAENLKKYFNAGHSDVADNGTLFIGILKNWKEESDRKIMQSQIVSFYFKLFKNFKDDQSIQKSVETIKEDMNVKFFNSNKKKRDDFEKLTN

SEQ ID NO: 292 - protein, 100 aa, Homo sapiens
CYCQDPYVKEAENLKKYFNAGHSDVADNGTLFLGILQNWKEESDRKIMQSQIVSFYFKLFKNFKDDQSIQKSVETIKEDMNVKFFNSNKKKRDDFEKLTN

SEQ ID NO: 293 - protein, 100 aa, Homo sapiens
CYCQDPYVKEAENLKKYFNAGHSDVADNGTLFLGILNNWKEESDRKIMQSQIVSFYFKLFKNFKDDQSIQKSVETIKEDMNVKFFNSNKKKRDDFEKLTN

SEQ ID NO: 294 - protein, 100 aa, Homo sapiens
CYCQDPYVKEAENLKKYFNAGHSDVADNGTLFLGILKNWQEESDRKIMQSQIVSFYFKLFKNFKDDQSIQKSVETIKEDMNVKFFNSNKKKRDDFEKLTN

SEQ ID NO: 295 - protein, 100 aa, Homo sapiens
CYCQDPYVKEAENLKKYFNAGHSDVADNGTLFLGILKNWNEESDRKIMQSQIVSFYFKLFKNFKDDQSIQKSVETIKEDMNVKFFNSNKKKRDDFEKLTN

SEQ ID NO: 296 - protein, 100 aa, Homo sapiens
CYCQDPYVKEAENLKKYFNAGHSDVADNGTLFLGILKNWKQESDRKIMQSQIVSFYFKLFKNFKDDQSIQKSVETIKEDMNVKFFNSNKKKRDDFEKLTN

SEQ ID NO: 297 - protein, 100 aa, Homo sapiens
CYCQDPYVKEAENLKKYFNAGHSDVADNGTLFLGILKNWKNESDRKIMQSQIVSFYFKLFKNFKDDQSIQKSVETIKEDMNVKFFNSNKKKRDDFEKLTN

SEQ ID NO: 298 - protein, 100 aa, Homo sapiens
CYCQDPYVKEAENLKKYFNAGHSDVADNGTLFLGILKNWKHESDRKIMQSQIVSFYFKLFKNFKDDQSIQKSVETIKEDMNVKFFNSNKKKRDDFEKLTN

SEQ ID NO: 299 - protein, 100 aa, Homo sapiens
CYCQDPYVKEAENLKKYFNAGHSDVADNGTLFLGILKNWKEQSDRKIMQSQIVSFYFKLFKNFKDDQSIQKSVETIKEDMNVKFFNSNKKKRDDFEKLTN

SEQ ID NO: 300 - protein, 100 aa, Homo sapiens
CYCQDPYVKEAENLKKYFNAGHSDVADNGTLFLGILKNWKENSDRKIMQSQIVSFYFKLFKNFKDDQSIQKSVETIKEDMNVKFFNSNKKKRDDFEKLTN

SEQ ID NO: 301 - protein, 100 aa, Homo sapiens
CYCQDPYVKEAENLKKYFNAGHSDVADNGTLFLGILKNWKEHSDRKIMQSQIVSFYFKLFKNFKDDQSIQKSVETIKEDMNVKFFNSNKKKRDDFEKLTN

SEQ ID NO: 302 - protein, 100 aa, Homo sapiens
CYCQDPYVKEAENLKKYFNAGHSDVADNGTLFLGILKNWKEESDRKIMQSQIVSFYFQLFKNFKDDQSIQKSVETIKEDMNVKFFNSNKKKRDDFEKLTN

SEQ ID NO: 303 - protein, 100 aa, Homo sapiens
CYCQDPYVKEAENLKKYFNAGHSDVADNGTLFLGILKNWKEESDRKIMQSQIVSFYFNLFKNFKDDQSIQKSVETIKEDMNVKFFNSNKKKRDDFEKLTN

SEQ ID NO: 304 - protein, 100 aa, Homo sapiens
CYCQDPYVKEAENLKKYFNAGHSDVADNGTLFLGILKNWKEESDRKIMQSQIVSFYFKLFQNFKDDQSIQKSVETIKEDMNVKFFNSNKKKRDDFEKLTN

SEQ ID NO: 305 - protein, 100 aa, Homo sapiens
CYCQDPYVKEAENLKKYFNAGHSDVADNGTLFLGILKNWKEESDRKIMQSQIVSFYFKLFNNFKDDQSIQKSVETIKEDMNVKFFNSNKKKRDDFEKLTN

SEQ ID NO: 306 - protein, 100 aa, Homo sapiens
CYCQDPYVKEAENLKKYFNAGHSDVADNGTLFLGILKNWKEESDRKIMQSQIVSFYFKLFKNFQDDQSIQKSVETIKEDMNVKFFNSNKKKRDDFEKLTN

SEQ ID NO: 307 - protein, 100 aa, Homo sapiens
CYCQDPYVKEAENLKKYFNAGHSDVADNGTLFLGILKNWKEESDRKIMQSQIVSFYFKLFKNFNDDQSIQKSVETIKEDMNVKFFNSNKKKRDDFEKLTN

SEQ ID NO: 308 - protein, 100 aa, Homo sapiens
CYCQDPYVKEAENLKKYFNAGHSDVADNGTLFLGILKNWKEESDRKIMQSQIVSFYFKLFKNFKQDQSIQKSVETIKEDMNVKFFNSNKKKRDDFEKLTN

SEQ ID NO: 309 - protein, 100 aa, Homo sapiens
CYCQDPYVKEAENLKKYFNAGHSDVADNGTLFLGILKNWKEESDRKIMQSQIVSFYFKLFKNFKNDQSIQKSVETIKEDMNVKFFNSNKKKRDDFEKLTN

SEQ ID NO: 310 - protein, 100 aa, Homo sapiens
CYCQDPYVKEAENLKKYFNAGHSDVADNGTLFLGILKNWKEESDRKIMQSQIVSFYFKLFKNFKDQQSIQKSVETIKEDMNVKFFNSNKKKRDDFEKLTN

SEQ ID NO: 311 - protein, 100 aa, Homo sapiens
CYCQDPYVKEAENLKKYFNAGHSDVADNGTLFLGILKNWKEESDRKIMQSQIVSFYFKLFKNFKDNQSIQKSVETIKEDMNVKFFNSNKKKRDDFEKLTN

SEQ ID NO: 312-361 - skipped (50 entries)

SEQ ID NO: 362 - protein, 127 aa, Homo sapiens
APARSPSPSTQPWEHVNAIQEARRLLNLSRDTAAEMNQTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 363 - protein, 127 aa, Homo sapiens
APARSPSPSTQPWEHVNAIQEARRLLNLSRDTAAEMNNTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 364 - protein, 127 aa, Homo sapiens
APARSPSPSTQPWEHVNAIQEARRLLNLSRDTAAEMNHTVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 365 - protein, 127 aa, Homo sapiens
APARSPSPSTQPWEHVNAIQEARRLLNLSRDTAAEMNETVQVISEMFDLQEPTCLQTRLELYKQGLRGSLTKLKGPLTMMASHYKQHCPPTPETSCATQIITFESFKENLKDFLLVIPFDCWEPVQE

SEQ ID NO: 366 - protein, 127 aa, Homo sapiens
APARSPSPSTQPWEHVNAIQEARRLLNLSRDTAAEMNETVNVISEMFDLQEPTCLQTRLELYKQGLRGSLTKLKGPLTMMASHYKQHCPPTPETSCATQIITFESFKENLKDFLLVIPFDCWEPVQE

SEQ ID NO: 367 - protein, 127 aa, Homo sapiens
APARSPSPSTQPWEHVNAIQEARRLLNLSRDTAAEMNETVHVISEMFDLQEPTCLQTRLELYKQGLRGSLTKLKGPLTMMASHYKQHCPPTPETSCATQIITFESFKENLKDFLLVIPFDCWEPVQE

SEQ ID NO: 368 - protein, 127 aa, Homo sapiens
APARSPSPSTQPWEHVNAIQEARRLLNLSRDTAAEMNETVEVISQMFDLQEPTCLQTRLELYKQGLRGSLTKLKGPLTMMASHYKQHCPPTPETSCATQIITFESFKENLKDFLLVIPFDCWEPVQE

SEQ ID NO: 369 - protein, 127 aa, Homo sapiens
APARSPSPSTQPWEHVNAIQEARRLLNLSRDTAAEMNETVEVISNMFDLQEPTCLQTRLELYKQGLRGSLTKLKGPLTMMASHYKQHCPPTPETSCATQIITFESFKENLKDFLLVIPFDCWEPVQE

SEQ ID NO: 370 - protein, 127 aa, Homo sapiens
APARSPSPSTQPWEHVNAIQEARRLLNLSRDTAAEMNETVEVISHMFDLQEPTCLQTRLELYKQGLRGSLTKLKGPLTMMASHYKQHCPPTPETSCATQIITFESFKENLKDFLLVIPFDCWEPVQE

SEQ ID NO: 371 - protein, 127 aa, Homo sapiens
APARSPSPSTQPWEHVNAIQEARRLLNLSRDTAAEMNETVEVISEVFDLQEPTCLQTRLELYKQGLRGSLTKLKGPLTMMASHYKQHCPPTPETSCATQIITFESFKENLKDFLLVIPFDCWEPVQE

SEQ ID NO: 372 - protein, 127 aa, Homo sapiens
APARSPSPSTQPWEHVNAIQEARRLLNLSRDTAAEMNETVEVISEIFDLQEPTCLQTRLELYKQGLRGSLTKLKGPLTMMASHYKQHCPPTPETSCATQIITFESFKENLKDFLLVIPFDCWEPVQE

SEQ ID NO: 373 - protein, 127 aa, Homo sapiens
APARSPSPSTQPWEHVNAIQEARRLLNLSRDTAAEMNETVEVISEMFQLQEPTCLQTRLELYKQGLRGSLTKLKGPLTMMASHYKQHCPPTPETSCATQIITFESFKENLKDFLLVIPFDCWEPVQE

SEQ ID NO: 374 - protein, 127 aa, Homo sapiens
APARSPSPSTQPWEHVNAIQEARRLLNLSRDTAAEMNETVEVISEMFNLQEPTCLQTRLELYKQGLRGSLTKLKGPLTMMASHYKQHCPPTPETSCATQIITFESFKENLKDFLLVIPFDCWEPVQE

SEQ ID NO: 375 - protein, 127 aa, Homo sapiens
APARSPSPSTQPWEHVNAIQEARRLLNLSRDTAAEMNETVEVISEMFDVQEPTCLQTRLELYKQGLRGSLTKLKGPLTMMASHYKQHCPPTPETSCATQIITFESFKENLKDFLLVIPFDCWEPVQE

SEQ ID NO: 376 - protein, 127 aa, Homo sapiens
APARSPSPSTQPWEHVNAIQEARRLLNLSRDTAAEMNETVEVISEMFDIQEPTCLQTRLELYKQGLRGSLTKLKGPLTMMASHYKQHCPPTPETSCATQIITFESFKENLKDFLLVIPFDCWEPVQE

SEQ ID NO: 377 - protein, 127 aa, Homo sapiens
APARSPSPSTQPWEHVNAIQEARRLLNLSRDTAAEMNETVEVISEMFDLQQPTCLQTRLELYKQGLRGSLTKLKGPLTMMASHYKQHCPPTPETSCATQIITFESFKENLKDFLLVIPFDCWEPVQE

SEQ ID NO: 378 - protein, 127 aa, Homo sapiens
APARSPSPSTQPWEHVNAIQEARRLLNLSRDTAAEMNETVEVISEMFDLQNPTCLQTRLELYKQGLRGSLTKLKGPLTMMASHYKQHCPPTPETSCATQIITFESFKENLKDFLLVIPFDCWEPVQE

SEQ ID NO: 379 - protein, 127 aa, Homo sapiens
APARSPSPSTQPWEHVNAIQEARRLLNLSRDTAAEMNETVEVISEMFDLQHPTCLQTRLELYKQGLRGSLTKLKGPLTMMASHYKQHCPPTPETSCATQIITFESFKENLKDFLLVIPFDCWEPVQE

SEQ ID NO: 380 - protein, 127 aa, Homo sapiens
APARSPSPSTQPWEHVNAIQEARRLLNLSRDTAAEMNETVEVISEMFDLQEPTCLQTRLQLYKQGLRGSLTKLKGPLTMMASHYKQHCPPTPETSCATQIITFESFKENLKDFLLVIPFDCWEPVQE

SEQ ID NO: 381 - protein, 127 aa, Homo sapiens
APARSPSPSTQPWEHVNAIQEARRLLNLSRDTAAEMNETVEVISEMFDLQEPTCLQTRLNLYKQGLRGSLTKLKGPLTMMASHYKQHCPPTPETSCATQIITFESFKENLKDFLLVIPFDCWEPVQE

SEQ ID NO: 382 - protein, 127 aa, Homo sapiens
APARSPSPSTQPWEHVNAIQEARRLLNLSRDTAAEMNETVEVISEMFDLQEPTCLQTRLHLYKQGLRGSLTKLKGPLTMMASHYKQHCPPTPETSCATQIITFESFKENLKDFLLVIPFDCWEPVQE

SEQ ID NO: 383 - protein, 127 aa, Homo sapiens
APARSPSPSTQPWEHVNAIQEARRLLNLSRDTAAEMNETVEVISEMFDLQEPTCLQTRLELYQQGLRGSLTKLKGPLTMMASHYKQHCPPTPETSCATQIITFESFKENLKDFLLVIPFDCWEPVQE

SEQ ID NO: 384 - protein, 127 aa, Homo sapiens
APARSPSPSTQPWEHVNAIQEARRLLNLSRDTAAEMNETVEVISEMFDLQEPTCLQTRLELYNQGLRGSLTKLKGPLTMMASHYKQHCPPTPETSCATQIITFESFKENLKDFLLVIPFDCWEPVQE

SEQ ID NO: 385 - protein, 127 aa, Homo sapiens
APARSPSPSTQPWEHVNAIQEARRLLNLSRDTAAEMNETVEVISEMFDLQEPTCLQTRLELYKQGLHGSLTKLKGPLTMMASHYKQHCPPTPETSCATQIITFESFKENLKDFLLVIPFDCWEPVQE

SEQ ID NO: 386 - protein, 127 aa, Homo sapiens
APARSPSPSTQPWEHVNAIQEARRLLNLSRDTAAEMNETVEVISEMFDLQEPTCLQTRLELYKQGLQGSLTKLKGPLTMMASHYKQHCPPTPETSCATQIITFESFKENLKDFLLVIPFDCWEPVQE

SEQ ID NO: 387 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTSETSCATQIITFESFKENLKDFLLVIPFDCWEPVQE

SEQ ID NO: 388 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTAETSCATQIITFESFKENLKDFLLVIPFDCWEPVQE

SEQ ID NO: 389 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPQTSCATQIITFESFKENLKDFLLVIPFDCWEPVQE

SEQ ID NO: 390 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPNTSCATQIITFESFKENLKDFLLVIPFDCWEPVQE

SEQ ID NO: 391 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPHTSCATQIITFESFKENLKDFLLVIPFDCWEPVQE

SEQ ID NO: 392 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPIDCWEPVQE

SEQ ID NO: 393 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPVDCWEPVQE

SEQ ID NO: 394 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFQCWEPVQE

SEQ ID NO: 395 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFNCWEPVQE

SEQ ID NO: 396 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWQPVQE

SEQ ID NO: 397 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWNPVQE

SEQ ID NO: 398 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWHPVQE

SEQ ID NO: 399 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWESVQE

SEQ ID NO: 400 - protein, 127 aa, Homo sapiens
APARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEAVQE

SEQ ID NO: 401-630 - skipped (230 entries)

SEQ ID NO: 631 - protein, 177 aa, homo sapiens
TPLGPASSLPQSFLLKCLEQVRKIQGDGAALQEKLVSECATYKLCHPEELVLLGHSLGIPSAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 632 - protein, 177 aa, homo sapiens
TPLGPASSLPQSFLLKCLEQVRKIQGDGAALQEKLVSECATYKLCHPEELVLLGHSLGIPHAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 633 - protein, 177 aa, homo sapiens
TPLGPASSLPQSFLLKCLEQVRKIQGDGAALQEKLVSECATYKLCHPEELVLLGHSLGIPWASLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 634 - protein, 177 aa, homo sapiens
TPLGPASSLPQSFLLKCLEQVRKIQGDGAALQEKLVSECATYKLCHPEELVLLGHSLGIPWAALSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 635 - protein, 177 aa, homo sapiens
TPLGPASSLPQSFLLKCLEQVRKIQGDGAALQEKLVSECATYKLCHPEELVLLGHSLGIPWAPLSSCSSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 636 - protein, 177 aa, homo sapiens
TPLGPASSLPQSFLLKCLEQVRKIQGDGAALQEKLVSECATYKLCHPEELVLLGHSLGIPWAPLSSCASQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 637 - protein, 177 aa, homo sapiens
TPLGPASSLPQSFLLKCLEQVRKIQGDGAALQEKLVSECATYKLCHPEELVLLGHSLGIPWAPLSSCPSQAVQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 638 - protein, 177 aa, homo sapiens
TPLGPASSLPQSFLLKCLEQVRKIQGDGAALQEKLVSECATYKLCHPEELVLLGHSLGIPWAPLSSCPSQAIQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 639 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLILYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 640 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLVLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 641 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALQGISPELGPTLDTLQLDVADFATTIWQQMEELGMAPALQPTQGAMPAFASAFQRRAGGVLVASHLQSFLEVSYRVLRHLAQP

SEQ ID NO: 642 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALNGISPELGPTLDTLQLDVADFATTIWQQMEELGMAPALQPTQGAMPAFASAFQRRAGGVLVASHLQSFLEVSYRVLRHLAQP

SEQ ID NO: 643 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALHGISPELGPTLDTLQLDVADFATTIWQQMEELGMAPALQPTQGAMPAFASAFQRRAGGVLVASHLQSFLEVSYRVLRHLAQP

SEQ ID NO: 644 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISSELGPTLDTLQLDVADFATTIWQQMEELGMAPALQPTQGAMPAFASAFQRRAGGVLVASHLQSFLEVSYRVLRHLAQP

SEQ ID NO: 645 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISAELGPTLDTLQLDVADFATTIWQQMEELGMAPALQPTQGAMPAFASAFQRRAGGVLVASHLQSFLEVSYRVLRHLAQP

SEQ ID NO: 646 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPQLGPTLDTLQLDVADFATTIWQQMEELGMAPALQPTQGAMPAFASAFQRRAGGVLVASHLQSFLEVSYRVLRHLAQP

SEQ ID NO: 647 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPNLGPTLDTLQLDVADFATTIWQQMEELGMAPALQPTQGAMPAFASAFQRRAGGVLVASHLQSFLEVSYRVLRHLAQP

SEQ ID NO: 648 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPHLGPTLDTLQLDVADFATTIWQQMEELGMAPALQPTQGAMPAFASAFQRRAGGVLVASHLQSFLEVSYRVLRHLAQP

SEQ ID NO: 649 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMASALQPTQGAMPAFASAFQRRAGGVLVASHLQSFLEVSYRVLRHLAQP

SEQ ID NO: 650 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAAALQPTQGAMPAFASAFQRRAGGVLVASHLQSFLEVSYRVLRHLAQP

SEQ ID NO: 651 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPAVQPTQGAMPAFASAFQRRAGGVLVASHLQSFLEVSYRVLRHLAQP

SEQ ID NO: 652 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPAIQPTQGAMPAFASAFQRRAGGVLVASHLQSFLEVSYRVLRHLAQP

SEQ ID NO: 653 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQSTQGAMPAFASAFQRRAGGVLVASHLQSFLEVSYRVLRHLAQP

SEQ ID NO: 654 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQATQGAMPAFASAFQRRAGGVLVASHLQSFLEVSYRVLRHLAQP

SEQ ID NO: 655 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAIQRRAGGVLVASHLQSFLEVSYRVLRHLAQP

SEQ ID NO: 656 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAVQRRAGGVLVASHLQSFLEVSYRVLRHLAQP

SEQ ID NO: 657 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYHVLRHLAQP

SEQ ID NO: 658 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYQVLRHLAQP

SEQ ID NO: 659 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLHHLAQP

SEQ ID NO: 660 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLQHLAQP

SEQ ID NO: 661 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQS

SEQ ID NO: 662 - protein, 177 aa, homo sapiens
TPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQA

SEQ ID NO: 663-849 - skipped (187 entries)

SEQ ID NO: 850 - protein, 191 aa, Homo sapiens
FPTIPLSRLFDNAMLRAHRLHQLAFDTYQEFEEAYIPKEQKYSFLQNPQTSLCFSQSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 851 - protein, 191 aa, Homo sapiens
FPTIPLSRLFDNAMLRAHRLHQLAFDTYQEFEEAYIPKEQKYSFLQNPQTSLCFSNSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 852 - protein, 191 aa, Homo sapiens
FPTIPLSRLFDNAMLRAHRLHQLAFDTYQEFEEAYIPKEQKYSFLQNPQTSLCFSHSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 853 - protein, 191 aa, Homo sapiens
FPTIPLSRLFDNAMLRAHRLHQLAFDTYQEFEEAYIPKEQKYSFLQNPQTSLCFSESISTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 854 - protein, 191 aa, Homo sapiens
FPTIPLSRLFDNAMLRAHRLHQLAFDTYQEFEEAYIPKEQKYSFLQNPQTSLCFSESIATPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 855 - protein, 191 aa, Homo sapiens
FPTIPLSRLFDNAMLRAHRLHQLAFDTYQEFEEAYIPKEQKYSFLQNPQTSLCFSESIPTPSNHEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 856 - protein, 191 aa, Homo sapiens
FPTIPLSRLFDNAMLRAHRLHQLAFDTYQEFEEAYIPKEQKYSFLQNPQTSLCFSESIPTPSNQEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 857 - protein, 191 aa, Homo sapiens
FPTIPLSRLFDNAMLRAHRLHQLAFDTYQEFEEAYIPKEQKYSFLQNPQTSLCFSESIPTPSNRQETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 858 - protein, 191 aa, Homo sapiens
FPTIPLSRLFDNAMLRAHRLHQLAFDTYQEFEEAYIPKEQKYSFLQNPQTSLCFSESIPTPSNRNETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 859 - protein, 191 aa, Homo sapiens
FPTIPLSRLFDNAMLRAHRLHQLAFDTYQEFEEAYIPKEQKYSFLQNPQTSLCFSESIPTPSNRHETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 860 - protein, 191 aa, Homo sapiens
FPTIPLSRLFDNAMLRAHRLHQLAFDTYQEFEEAYIPKEQKYSFLQNPQTSLCFSESIPTPSNREQTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 861 - protein, 191 aa, Homo sapiens
FPTIPLSRLFDNAMLRAHRLHQLAFDTYQEFEEAYIPKEQKYSFLQNPQTSLCFSESIPTPSNRENTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 862 - protein, 191 aa, Homo sapiens
FPTIPLSRLFDNAMLRAHRLHQLAFDTYQEFEEAYIPKEQKYSFLQNPQTSLCFSESIPTPSNREHTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 863 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLQPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 864 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLNPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 865 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLHPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 866 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQILRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 867 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQVLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 868 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLHSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 869 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLQSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 870 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSVVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 871 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSIVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 872 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLQDGSPRTGQIFKQTYSKFDTNSHNDDALLKNYGLLYCFRKDMDKVETFLRIVQCRSVEGSCGF

SEQ ID NO: 873 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLNDGSPRTGQIFKQTYSKFDTNSHNDDALLKNYGLLYCFRKDMDKVETFLRIVQCRSVEGSCGF

SEQ ID NO: 874 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLHDGSPRTGQIFKQTYSKFDTNSHNDDALLKNYGLLYCFRKDMDKVETFLRIVQCRSVEGSCGF

SEQ ID NO: 875 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEQGSPRTGQIFKQTYSKFDTNSHNDDALLKNYGLLYCFRKDMDKVETFLRIVQCRSVEGSCGF

SEQ ID NO: 876 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLENGSPRTGQIFKQTYSKFDTNSHNDDALLKNYGLLYCFRKDMDKVETFLRIVQCRSVEGSCGF

SEQ ID NO: 877 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSSRTGQIFKQTYSKFDTNSHNDDALLKNYGLLYCFRKDMDKVETFLRIVQCRSVEGSCGF

SEQ ID NO: 878 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSARTGQIFKQTYSKFDTNSHNDDALLKNYGLLYCFRKDMDKVETFLRIVQCRSVEGSCGF

SEQ ID NO: 879 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPHTGQIFKQTYSKFDTNSHNDDALLKNYGLLYCFRKDMDKVETFLRIVQCRSVEGSCGF

SEQ ID NO: 880 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPQTGQIFKQTYSKFDTNSHNDDALLKNYGLLYCFRKDMDKVETFLRIVQCRSVEGSCGF

SEQ ID NO: 881 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFQQTYSKFDTNSHNDDALLKNYGLLYCFRKDMDKVETFLRIVQCRSVEGSCGF

SEQ ID NO: 882 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFNQTYSKFDTNSHNDDALLKNYGLLYCFRKDMDKVETFLRIVQCRSVEGSCGF

SEQ ID NO: 883 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTHSKFDTNSHNDDALLKNYGLLYCFRKDMDKVETFLRIVQCRSVEGSCGF

SEQ ID NO: 884 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTISKFDTNSHNDDALLKNYGLLYCFRKDMDKVETFLRIVQCRSVEGSCGF

SEQ ID NO: 885 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSQFDTNSHNDDALLKNYGLLYCFRKDMDKVETFLRIVQCRSVEGSCGF

SEQ ID NO: 886 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSNFDTNSHNDDALLKNYGLLYCFRKDMDKVETFLRIVQCRSVEGSCGF

SEQ ID NO: 887 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKIDTNSHNDDALLKNYGLLYCFRKDMDKVETFLRIVQCRSVEGSCGF

SEQ ID NO: 888 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKVDTNSHNDDALLKNYGLLYCFRKDMDKVETFLRIVQCRSVEGSCGF

SEQ ID NO: 889 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFQTNSHNDDALLKNYGLLYCFRKDMDKVETFLRIVQCRSVEGSCGF

SEQ ID NO: 890 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFNTNSHNDDALLKNYGLLYCFRKDMDKVETFLRIVQCRSVEGSCGF

SEQ ID NO: 891 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCHSVEGSCGF

SEQ ID NO: 892 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCQSVEGSCGF

SEQ ID NO: 893 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVQGSCGF

SEQ ID NO: 894 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVNGSCGF

SEQ ID NO: 895 - protein, 191 aa, Homo sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVHGSCGF

SEQ ID NO: 896-939 - skipped (44 entries)

SEQ ID NO: 940 - protein, 166 aa, Homo sapiens
APPRLICDSRVLERYLLEAKEAENITTGCAEHCSLNENITVPQTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 941 - protein, 166 aa, Homo sapiens
APPRLICDSRVLERYLLEAKEAENITTGCAEHCSLNENITVPNTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 942 - protein, 166 aa, Homo sapiens
APPRLICDSRVLERYLLEAKEAENITTGCAEHCSLNENITVPDTQVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 943 - protein, 166 aa, Homo sapiens
APPRLICDSRVLERYLLEAKEAENITTGCAEHCSLNENITVPDTNVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 944 - protein, 166 aa, Homo sapiens
APPRLICDSRVLERYLLEAKEAENITTGCAEHCSLNENITVPDTKVNIYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 945 - protein, 166 aa, Homo sapiens
APPRLICDSRVLERYLLEAKEAENITTGCAEHCSLNENITVPDTKVNVYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 946 - protein, 166 aa, Homo sapiens
APPRLICDSRVLERYLLEAKEAENITTGCAEHCSLNENITVPDTKVNFHAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 947 - protein, 166 aa, Homo sapiens
APPRLICDSRVLERYLLEAKEAENITTGCAEHCSLNENITVPDTKVNFIAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 948 - protein, 166 aa, Homo sapiens
APPRLICDSRVLERYLLEAKEAENITTGCAEHCSLNENITVPDTKVNFYAWQRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 949 - protein, 166 aa, Homo sapiens
APPRLICDSRVLERYLLEAKEAENITTGCAEHCSLNENITVPDTKVNFYAWNRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 950 - protein, 166 aa, Homo sapiens
APPRLICDSRVLERYLLEAKEAENITTGCAEHCSLNENITVPDTKVNFYAWKHMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 951 - protein, 166 aa, Homo sapiens
APPRLICDSRVLERYLLEAKEAENITTGCAEHCSLNENITVPDTKVNFYAWKQMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 952 - protein, 166 aa, Homo sapiens
APPRLICDSRVLERYLLEAKEAENITTGCAEHCSLNENITVPDTKVNFYAWKRMQVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 953 - protein, 166 aa, Homo sapiens
APPRLICDSRVLERYLLEAKEAENITTGCAEHCSLNENITVPDTKVNFYAWKRMNVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 954 - protein, 166 aa, Homo sapiens
APPRLICDSRVLERYLLEAKEAENITTGCAEHCSLNENITVPDTKVNFYAWKRMHVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 955 - protein, 166 aa, Homo sapiens
APPRLICDSRVLERYLLEAKEAENITTGCAEHCSLNENITVPDTKVNFYAWKRMEVGQQAVEVWQGLALLSQAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 956 - protein, 166 aa, Homo sapiens
APPRLICDSRVLERYLLEAKEAENITTGCAEHCSLNENITVPDTKVNFYAWKRMEVGQQAVEVWQGLALLSNAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 957 - protein, 166 aa, Homo sapiens
APPRLICDSRVLERYLLEAKEAENITTGCAEHCSLNENITVPDTKVNFYAWKRMEVGQQAVEVWQGLALLSHAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 958 - protein, 166 aa, Homo sapiens
APPRLICDSRVLERYLLEAKEAENITTGCAEHCSLNENITVPDTKVNFYAWKRMEVGQQAVEVWQGLALLSEAVVRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 959 - protein, 166 aa, Homo sapiens
APPRLICDSRVLERYLLEAKEAENITTGCAEHCSLNENITVPDTKVNFYAWKRMEVGQQAVEVWQGLALLSEAVIRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 960 - protein, 166 aa, Homo sapiens
APPRLICDSRVLERYLLEAKEAENITTGCAEHCSLNENITVPDTKVNFYAWKRMEVGQQAVEVWQGLALLSEAVLHGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 961 - protein, 166 aa, Homo sapiens
APPRLICDSRVLERYLLEAKEAENITTGCAEHCSLNENITVPDTKVNFYAWKRMEVGQQAVEVWQGLALLSEAVLQGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 962 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPQAASAAPLRTITADTFRKLFRVYSNFLRGKLKLYTGEACRTGDR

SEQ ID NO: 963 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPNAASAAPLRTITADTFRKLFRVYSNFLRGKLKLYTGEACRTGDR

SEQ ID NO: 964 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAASLRTITADTFRKLFRVYSNFLRGKLKLYTGEACRTGDR

SEQ ID NO: 965 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAALRTITADTFRKLFRVYSNFLRGKLKLYTGEACRTGDR

SEQ ID NO: 966 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPVRTITADTFRKLFRVYSNFLRGKLKLYTGEACRTGDR

SEQ ID NO: 967 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPIRTITADTFRKLFRVYSNFLRGKLKLYTGEACRTGDR

SEQ ID NO: 968 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLHTITADTFRKLFRVYSNFLRGKLKLYTGEACRTGDR

SEQ ID NO: 969 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLQTITADTFRKLFRVYSNFLRGKLKLYTGEACRTGDR

SEQ ID NO: 970 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACHTGDR

SEQ ID NO: 971 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACQTGDR

SEQ ID NO: 972 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGQR

SEQ ID NO: 973 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGNR

SEQ ID NO: 974 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISSPDAASAAPLRTITADTFRKLFRVYSNFLRGKLKLYTGEACHTGDR

SEQ ID NO: 975 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISAPDAASAAPLRTITADTFRKLFRVYSNFLRGKLKLYTGEACQTGDR

SEQ ID NO: 976 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPSDAASAAPLRTITADTFRKLFRVYSNFLRGKLKLYTGEACRTGQR

SEQ ID NO: 977 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPADAASAAPLRTITADTFRKLFRVYSNFLRGKLKLYTGEACRTGNR

SEQ ID NO: 978 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLVKEDSILAVRKYFQRITLYLKEKKYSPCAWEVVRAEIMRSFSLSTNLPESLRSKE

SEQ ID NO: 979 - protein, 165 aa, Homo sapiens
CDLPQTHSLGSRRTLMLLAQMRRISLFSCLKDRHDFGFPQHEFGDQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQESLRSKE

SEQ ID NO: 980 - protein, 165 aa, Homo sapiens
CDLPQTHSLGSRRTLMLLAQMRRISLFSCLKDRHDFGFPQQEFGNQFQKAETIPVLHEMIQQIFNLFSTKDSSAAWDETLLDKFYTELYQQLNGLEACVIQGVGVTETPLMKEDSILAVRKYFQRITLYLKEKKYSPCAWEVVRAEIMRSFSLSTNLQESLRSKE

SEQ ID NO: 981 - protein, 165 aa, Homo sapiens
CDLPQTHSLGSRRTLMLLAQMRRISLVSCLKDRHDFGFPQEEFGNQFQKAETIPVLHQMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 982 - protein, 165 aa, Homo sapiens
CDLPQTHSLGSRRTLMLLAQMRRISLFSCLKDHHDFGFPQEEFGNQFQKAETIPVLHHMIQQIFNLFSTKDSSAAWDHTLLDKFYTELYQQLNDLEACVIQGVGVTETPVMKEDSILAVRKYFQRITLYLKEKKYSPCAWEVVRAEIMRSFSLSTNLQESLRSKE

SEQ ID NO: 983 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETALMKEDSILAVRQYFQRITLYLKEKKYSPCAWEVVRAEIMRSFSLSTNLQESLRSKE

SEQ ID NO: 984 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQRVGVTETALMKEDSILAVRQYFQRITLYLKEQKYSPCAWEVVRAEIMRSFSLSTNLQESLRSKE

SEQ ID NO: 985 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIVAVRKYFQRITLYLKEKKYSPCGWEVVRAEIMRSFSLSTNLQESLRSKE

SEQ ID NO: 986 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLVKEDSILAVRKYFQHITLYLKEKKYSPCAWEVVRAEIMRSFSLSTNLPESLRSKE

SEQ ID NO: 987 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQHSLRSKE

SEQ ID NO: 988 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIAGVGVTETPLMKEDSILAVRKYFQRITLYLKEKKYSPCAWEVVRAEIMRSFSLSTNLQESLRSKE

SEQ ID NO: 989 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLTRYYGRILHYLKAKEYSHCAWTIVRVEILRNFYFINRLTGYLRN

SEQ ID NO: 990 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLSRYYGRILHYLKAKEYSHCAWTIVRVEILRNFYFINRLTGYLRN

SEQ ID NO: 991 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLHRYYGRILHYLKAKEYSHCAWTIVRVEILRNFYFINRLTGYLRN

SEQ ID NO: 992 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKHYYGRILHYLKAKEYSHCAWTIVRVEILRNFYFINRLTGYLRN

SEQ ID NO: 993 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKQYYGRILHYLKAKEYSHCAWTIVRVEILRNFYFINRLTGYLRN

SEQ ID NO: 994 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGHILHYLKAKEYSHCAWTIVRVEILRNFYFINRLTGYLRN

SEQ ID NO: 995 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGQILHYLKAKEYSHCAWTIVRVEILRNFYFINRLTGYLRN

SEQ ID NO: 996 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIVHYLKAKEYSHCAWTIVRVEILRNFYFINRLTGYLRN

SEQ ID NO: 997 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIIHYLKAKEYSHCAWTIVRVEILRNFYFINRLTGYLRN

SEQ ID NO: 998 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRITHYLKAKEYSHCAWTIVRVEILRNFYFINRLTGYLRN

SEQ ID NO: 999 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIQHYLKAKEYSHCAWTIVRVEILRNFYFINRLTGYLRN

SEQ ID NO: 1000 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIHHYLKAKEYSHCAWTIVRVEILRNFYFINRLTGYLRN

SEQ ID NO: 1001 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRIAHYLKAKEYSHCAWTIVRVEILRNFYFINRLTGYLRN

SEQ ID NO: 1002 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLQAKEYSHCAWTIVRVEILRNFYFINRLTGYLRN

SEQ ID NO: 1003 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLTAKEYSHCAWTIVRVEILRNFYFINRLTGYLRN

SEQ ID NO: 1004 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLSAKEYSHCAWTIVRVEILRNFYFINRLTGYLRN

SEQ ID NO: 1005 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLHAKEYSHCAWTIVRVEILRNFYFINRLTGYLRN

SEQ ID NO: 1006 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAQEYSHCAWTIVRVEILRNFYFINRLTGYLRN

SEQ ID NO: 1007 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKATEYSHCAWTIVRVEILRNFYFINRLTGYLRN

SEQ ID NO: 1008 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKASEYSHCAWTIVRVEILRNFYFINRLTGYLRN

SEQ ID NO: 1009 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAHEYSHCAWTIVRVEILRNFYFINRLTGYLRN

SEQ ID NO: 1010 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKQYSHCAWTIVRVEILRNFYFINRLTGYLRN

SEQ ID NO: 1011 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKHYSHCAWTIVRVEILRNFYFINRLTGYLRN

SEQ ID NO: 1012 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGHLRN

SEQ ID NO: 1013 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGILRN

SEQ ID NO: 1014 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLHN

SEQ ID NO: 1015 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLQN

SEQ ID NO: 1016 - protein, 166 aa, Homo sapiens
VSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1017 - protein, 166 aa, Homo sapiens
ISYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1018 - protein, 166 aa, Homo sapiens
TSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1019 - protein, 166 aa, Homo sapiens
ASYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1020 - protein, 166 aa, Homo sapiens
MSYNVLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1021 - protein, 166 aa, Homo sapiens
MSYNILGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1022 - protein, 166 aa, Homo sapiens
MSYNTLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1023 - protein, 166 aa, Homo sapiens
MSYNQLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1024 - protein, 166 aa, Homo sapiens
MSYNHLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1025 - protein, 166 aa, Homo sapiens
MSYNALGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1026 - protein, 166 aa, Homo sapiens
MSYNLLGILQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1027 - protein, 166 aa, Homo sapiens
MSYNLLGVLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1028 - protein, 166 aa, Homo sapiens
MSYNLLGFVQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1029 - protein, 166 aa, Homo sapiens
MSYNLLGFIQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1030 - protein, 166 aa, Homo sapiens
MSYNLLGFTQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1031 - protein, 166 aa, Homo sapiens
MSYNLLGFQQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1032 - protein, 166 aa, Homo sapiens
MSYNLLGFHQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1033 - protein, 166 aa, Homo sapiens
MSYNLLGFAQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1034 - protein, 166 aa, Homo sapiens
MSYNLLGFLQHSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1035 - protein, 166 aa, Homo sapiens
MSYNLLGFLQQSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1036 - protein, 166 aa, Homo sapiens
MSYNLLGFLQRSSNIQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1037 - protein, 166 aa, Homo sapiens
MSYNLLGFLQRSSNVQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1038 - protein, 166 aa, Homo sapiens
MSYNLLGFLQRSSNFQCQQLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1039 - protein, 166 aa, Homo sapiens
MSYNLLGFLQRSSNFQCQTLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1040 - protein, 166 aa, Homo sapiens
MSYNLLGFLQRSSNFQCQSLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1041 - protein, 166 aa, Homo sapiens
MSYNLLGFLQRSSNFQCQHLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1042 - protein, 166 aa, Homo sapiens
MSYNLLGFLQRSSNFQCQKLLSQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1043 - protein, 165 aa, Homo sapiens
MSYNLLGFLQRSSNFQCQKLLHQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLR

SEQ ID NO: 1044 - protein, 166 aa, Homo sapiens
MSYNLLGFLQRSSNFQCQKLLWQLHGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1045 - protein, 166 aa, Homo sapiens
MSYNLLGFLQRSSNFQCQKLLWQLSGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1046 - protein, 166 aa, Homo sapiens
MSYNLLGFLQRSSNFQCQKLLWQLQGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1047 - protein, 166 aa, Homo sapiens
MSYNLLGFLQRSSNFQCQKLLWQLNGHLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1048 - protein, 166 aa, Homo sapiens
MSYNLLGFLQRSSNFQCQKLLWQLNGQLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1049 - protein, 166 aa, Homo sapiens
MSYNLLGFLQRSSNFQCQKLLWQLNGRVEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1050 - protein, 166 aa, Homo sapiens
MSYNLLGFLQRSSNFQCQKLLWQLNGRIEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1051 - protein, 166 aa, Homo sapiens
MSYNLLGFLQRSSNFQCQKLLWQLNGRTEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1052 - protein, 166 aa, Homo sapiens
MSYNLLGFLQRSSNFQCQKLLWQLNGRQEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1053 - protein, 166 aa, Homo sapiens
MSYNLLGFLQRSSNFQCQKLLWQLNGRHEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1054 - protein, 166 aa, Homo sapiens
MSYNLLGFLQRSSNFQCQKLLWQLNGRAEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1055 - protein, 166 aa, Homo sapiens
MSYNLLGFLQRSSNFQCQKLLWQLNGRLQYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1056 - protein, 166 aa, Homo sapiens
MSYNLLGFLQRSSNFQCQKLLWQLNGRLHYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1057 - protein, 166 aa, Homo sapiens
MSYNLLGFLQRSSNFQCQKLLWQLNGRLEHCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1058 - protein, 166 aa, Homo sapiens
MSYNLLGFLQRSSNFQCQKLLWQLNGRLEICLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1059 - protein, 166 aa, Homo sapiens
MSYNLLGFLQRSSNFQCQKLLWQLNGRLEYCVKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1060 - protein, 166 aa, Homo sapiens
MSYNLLGFLQRSSNFQCQKLLWQLNGRLEYCIKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1061 - protein, 166 aa, Homo sapiens
MSYNLLGFLQRSSNFQCQKLLWQLNGRLEYCTKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1062 - protein, 166 aa, Homo sapiens
MSYNLLGFLQRSSNFQCQKLLWQLNGRLEYCQKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1063 - protein, 166 aa, Homo sapiens
MSYNLLGFLQRSSNFQCQKLLWQLNGRLEYCHKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1064 - protein, 166 aa, Homo sapiens
MSYNLLGFLQRSSNFQCQKLLWQLNGRLEYCAKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1065 - protein, 166 aa, Homo sapiens
QSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1066 - protein, 166 aa, Homo sapiens
MSYNLLGFLQRSSNFQCQKLLWQLNGRLEYCLQDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1067 - protein, 166 aa, Homo sapiens
MSYNLLGFLQRSSNFQCQKLLWQLNGRLEYCLTDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1068 - protein, 166 aa, Homo sapiens
MSYNLLGFLQRSSNFQCQKLLWQLNGRLEYCLSDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1069 - protein, 166 aa, Homo sapiens
MSYNLLGFLQRSSNFQCQKLLWQLNGRLEYCLHDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1070 - protein, 166 aa, Homo sapiens
MSYNLLGFLQRSSNFQCQKLLWQLNGRLEYCLKDHMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1071 - protein, 166 aa, Homo sapiens
MSYNLLGFLQRSSNFQCQKLLWQLNGRLEYCLKDQMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1072 - protein, 166 aa, Homo sapiens
MSYNLLGFLQRSSNFQCQKLLWQLNGRLEYCLKDRVNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1073 - protein, 166 aa, Homo sapiens
MSYNLLGFLQRSSNFQCQKLLWQLNGRLEYCLKDRINFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1074 - protein, 166 aa, Homo sapiens
MSYNLLGFLQRSSNFQCQKLLWQLNGRLEYCLKDRTNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1075 - protein, 166 aa, Homo sapiens
MSYNLLGFLQRSSNFQCQKLLWQLNGRLEYCLKDRQNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1076 - protein, 166 aa, Homo sapiens
MSYNLLGFLQRSSNFQCQKLLWQLNGRLEYCLKDRANFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1077 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVQNLLANVYHQINHLKTVLEEKLEKEDFTRGKLMSSLHLKRYYGRILHYLKAKEYSHCAWTIVRVEILRNFYFINRLTGYLRN

SEQ ID NO: 1078 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVHNLLANVYHQINHLKTVLEEKLEKEDFTRGKLMSSLHLKRYYGRILHYLKAKEYSHCAWTIVRVEILRNFYFINRLTGYLRN

SEQ ID NO: 1079 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVHHQINHLKTVLEEKLEKEDFTRGKLMSSLHLKRYYGRILHYLKAKEYSHCAWTIVRVEILRNFYFINRLTGYLRN

SEQ ID NO: 1080 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVIHQINHLKTVLEEKLEKEDFTRGKLMSSLHLKRYYGRILHYLKAKEYSHCAWTIVRVEILRNFYFINRLTGYLRN

SEQ ID NO: 1081 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLQTVLEEKLEKEDFTRGKLMSSLHLKRYYGRILHYLKAKEYSHCAWTIVRVEILRNFYFINRLTGYLRN

SEQ ID NO: 1082 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLTTVLEEKLEKEDFTRGKLMSSLHLKRYYGRILHYLKAKEYSHCAWTIVRVEILRNFYFINRLTGYLRN

SEQ ID NO: 1083 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLSTVLEEKLEKEDFTRGKLMSSLHLKRYYGRILHYLKAKEYSHCAWTIVRVEILRNFYFINRLTGYLRN

SEQ ID NO: 1084 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLHTVLEEKLEKEDFTRGKLMSSLHLKRYYGRILHYLKAKEYSHCAWTIVRVEILRNFYFINRLTGYLRN

SEQ ID NO: 1085 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLQEKLEKEDFTRGKLMSSLHLKRYYGRILHYLKAKEYSHCAWTIVRVEILRNFYFINRLTGYLRN

SEQ ID NO: 1086 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLHEKLEKEDFTRGKLMSSLHLKRYYGRILHYLKAKEYSHCAWTIVRVEILRNFYFINRLTGYLRN

SEQ ID NO: 1087 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEQKLEKEDFTRGKLMSSLHLKRYYGRILHYLKAKEYSHCAWTIVRVEILRNFYFINRLTGYLRN

SEQ ID NO: 1088 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEHKLEKEDFTRGKLMSSLHLKRYYGRILHYLKAKEYSHCAWTIVRVEILRNFYFINRLTGYLRN

SEQ ID NO: 1089 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEQLEKEDFTRGKLMSSLHLKRYYGRILHYLKAKEYSHCAWTIVRVEILRNFYFINRLTGYLRN

SEQ ID NO: 1090 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEETLEKEDFTRGKLMSSLHLKRYYGRILHYLKAKEYSHCAWTIVRVEILRNFYFINRLTGYLRN

SEQ ID NO: 1091 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEESLEKEDFTRGKLMSSLHLKRYYGRILHYLKAKEYSHCAWTIVRVEILRNFYFINRLTGYLRN

SEQ ID NO: 1092 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEHLEKEDFTRGKLMSSLHLKRYYGRILHYLKAKEYSHCAWTIVRVEILRNFYFINRLTGYLRN

SEQ ID NO: 1093 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEHSHCAWTIVRVEILRNFYFINRLTGYLRN

SEQ ID NO: 1094 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEISHCAWTIVRVEILRNFYFINRLTGYLRN

SEQ ID NO: 1095 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILHNFYFINRLTGYLRN

SEQ ID NO: 1096 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILQNFYFINRLTGYLRN

SEQ ID NO: 1097 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFHFINRLTGYLRN

SEQ ID NO: 1098 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFIFINRLTGYLRN

SEQ ID NO: 1099 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINHLTGYLRN

SEQ ID NO: 1100 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINQLTGYLRN

SEQ ID NO: 1101 - protein, 166 aa, Homo sapiens
DSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1102 - protein, 166 aa, Homo sapiens
ESYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1103 - protein, 166 aa, Homo sapiens
KSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1104 - protein, 166 aa, Homo sapiens
NSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1105 - protein, 166 aa, Homo sapiens
RSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1106 - protein, 166 aa, Homo sapiens
SSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1107 - protein, 166 aa, Homo sapiens
MSYNDLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1108 - protein, 166 aa, Homo sapiens
MSYNELGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1109 - protein, 166 aa, Homo sapiens
MSYNKLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1110 - protein, 166 aa, Homo sapiens
MSYNRLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1111 - protein, 166 aa, Homo sapiens
MSYNNLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1112 - protein, 166 aa, Homo sapiens
MSYNSLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1113 - protein, 166 aa, Homo sapiens
MSYNLDGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1114 - protein, 166 aa, Homo sapiens
MSYNLEGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1115 - protein, 166 aa, Homo sapiens
MSYNLKGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1116 - protein, 166 aa, Homo sapiens
MSYNLNGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1117 - protein, 166 aa, Homo sapiens
MSYNLQGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1118 - protein, 166 aa, Homo sapiens
MSYNLRGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1119 - protein, 166 aa, Homo sapiens
MSYNLSGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1120 - protein, 166 aa, Homo sapiens
MSYNLTGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1121 - protein, 166 aa, Homo sapiens
MSYNLLGDLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1122 - protein, 166 aa, Homo sapiens
MSYNLLGELQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1123 - protein, 166 aa, Homo sapiens
MSYNLLGKLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1124 - protein, 166 aa, Homo sapiens
MSYNLLGRLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1125 - protein, 166 aa, Homo sapiens
MSYNLLGFDQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1126 - protein, 166 aa, Homo sapiens
MSYNLLGFEQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1127 - protein, 166 aa, Homo sapiens
MSYNLLGFKQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1128 - protein, 166 aa, Homo sapiens
MSYNLLGFNQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1129 - protein, 166 aa, Homo sapiens
MSYNLLGFRQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1130 - protein, 166 aa, Homo sapiens
MSYNLLGFSQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1131 - protein, 166 aa, Homo sapiens
MSYNLLGFLDRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1132 - protein, 166 aa, Homo sapiens
MSYNLLGFLERSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1133 - protein, 166 aa, Homo sapiens
MSYNLLGFLKRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1134 - protein, 166 aa, Homo sapiens
MSYNLLGFLNRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1135 - protein, 166 aa, Homo sapiens
MSYNLLGFLRRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1136 - protein, 166 aa, Homo sapiens
MSYNLLGFLSRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1137 - protein, 166 aa, Homo sapiens
MSYNLLGFLTRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1138 - protein, 166 aa, Homo sapiens
MSYNLLGFLQRDSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1139 - protein, 166 aa, Homo sapiens
MSYNLLGFLQRESNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1140 - protein, 166 aa, Homo sapiens
MSYNLLGFLQRKSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1141 - protein, 166 aa, Homo sapiens
MSYNLLGFLQRRSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1142 - protein, 166 aa, Homo sapiens
MSYNLLGFLQRSDNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1143 - protein, 166 aa, Homo sapiens
MSYNLLGFLQRSENFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1144 - protein, 166 aa, Homo sapiens
MSYNLLGFLQRSKNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1145 - protein, 166 aa, Homo sapiens
MSYNLLGFLQRSNNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1146 - protein, 166 aa, Homo sapiens
MSYNLLGFLQRSQNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1147 - protein, 166 aa, Homo sapiens [sequence omitted]

SEQ ID NO: 1148 - protein, 166 aa, Homo sapiens
MSYNLLGFLQRSTNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1149 - protein, 166 aa, Homo sapiens
MSYNLLGFLQRSSDFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1150 - protein, 166 aa, Homo sapiens
MSYNLLGFLQRSSEFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1151 - protein, 166 aa, Homo sapiens
MSYNLLGFLQRSSKFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1152 - protein, 166 aa, Homo sapiens
MSYNLLGFLQRSSQFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1153 - protein, 166 aa, Homo sapiens
MSYNLLGFLQRSSRFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1154 - protein, 166 aa, Homo sapiens
MSYNLLGFLQRSSSFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1155 - protein, 166 aa, Homo sapiens
MSYNLLGFLQRSSTFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1156 - protein, 166 aa, Homo sapiens
MSYNLLGFLQRSSNDQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1157 - protein, 166 aa, Homo sapiens
MSYNLLGFLQRSSNEQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1158 - protein, 166 aa, Homo sapiens
MSYNLLGFLQRSSNKQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1159 - protein, 166 aa, Homo sapiens
MSYNLLGFLQRSSNRQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1160 - protein, 166 aa, Homo sapiens
MSYNLLGFLQRSSNFDCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1161 - protein, 166 aa, Homo sapiens
MSYNLLGFLQRSSNFECQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1162 - protein, 166 aa, Homo sapiens
MSYNLLGFLQRSSNFKCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1163 - protein, 166 aa, Homo sapiens
MSYNLLGFLQRSSNFNCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1164 - protein, 166 aa, Homo sapiens
MSYNLLGFLQRSSNFRCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1165 - protein, 166 aa, Homo sapiens
MSYNLLGFLQRSSNFSCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1166 - protein, 166 aa, Homo sapiens
MSYNLLGFLQRSSNFTCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1167 - protein, 166 aa, Homo sapiens
MSYNLLGFLQRSSNFQDQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1168 - protein, 166 aa, Homo sapiens
MSYNLLGFLQRSSNFQEQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1169 - protein, 166 aa, Homo sapiens
MSYNLLGFLQRSSNFQKQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1170 - protein, 166 aa, Homo sapiens
MSYNLLGFLQRSSNFQNQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1171 - protein, 166 aa, Homo sapiens
MSYNLLGFLQRSSNFQQQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1172 - protein, 166 aa, Homo sapiens
MSYNLLGFLQRSSNFQRQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1173 - protein, 166 aa, Homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1174 - protein, 166 aa, Homo sapiens
MSYNLLGFLQRSSNFQTQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1175 - protein, 166 aa, Homo sapiens
MSYNLLGFLQRSSNFQCQKNLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1176 - protein, 166 aa, Homo sapiens
MSYNLLGFLQRSSNFQCQKQLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1177 - protein, 166 aa, Homo sapiens
MSYNLLGFLQRSSNFQCQKRLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1178 - protein, 166 aa, Homo sapiens
MSYNLLGFLQRSSNFQCQKSLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1179 - protein, 166 aa, Homo sapiens
MSYNLLGFLQRSSNFQCQKTLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1180 - protein, 166 aa, Homo sapiens
MSYNLLGFLQRSSNFQCQKDLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1181 - protein, 166 aa, Homo sapiens
MSYNLLGFLQRSSNFQCQKELWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1182 - protein, 166 aa, Homo sapiens
MSYNLLGFLQRSSNFQCQKKLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1183 - protein, 166 aa, Homo sapiens
MSYNLLGFLQRSSNFQCQKLLDQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1184 - protein, 166 aa, Homo sapiens
MSYNLLGFLQRSSNFQCQKLLEQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1185 - protein, 166 aa, Homo sapiens
MSYNLLGFLQRSSNFQCQKLLKQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1186 - protein, 166 aa, Homo sapiens
MSYNLLGFLQRSSNFQCQKLLRQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1187 - protein, 166 aa, Homo sapiens
MSYNLLGFLQRSSNFQCQKLLWDLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1188 - protein, 166 aa, Homo sapiens
MSYNLLGFLQRSSNFQCQKLLWELNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1189 - protein, 166 aa, Homo sapiens
MSYNLLGFLQRSSNFQCQKLLWKLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1190 - protein, 166 aa, Homo sapiens
MSYNLLGFLQRSSNFQCQKLLWRLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1191 - protein, 166 aa, Homo sapiens
MSYNLLGFLQRSSNFQCQKLLWQDNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1192 - protein, 166 aa, Homo sapiens
MSYNLLGFLQRSSNFQCQKLLWQENGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1193 - protein, 166 aa, Homo sapiens
MSYNLLGFLQRSSNFQCQKLLWQKNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1194 - protein, 166 aa, Homo sapiens
MSYNLLGFLQRSSNFQCQKLLWQRNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1195 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTDWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1196 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTEWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1197 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTKWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1198 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTRWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1199 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGDNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1200 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGENETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1201 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGKNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1202 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGRNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1203 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWDETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1204 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWEETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1205 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWKETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1206 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWRETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1207 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEDIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1208 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEEIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1209 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNEKIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1210 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNERIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1211 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETDVENLLANVYHQINHLKTVLEEKLEKEDFTRGKLMSSLHLKRYYGRILHYLKAKEYSHCAWTIVRVEILRNFYFINRLTGYLRN

SEQ ID NO: 1212 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETEVENLLANVYHQINHLKTVLEEKLEKEDFTRGKLMSSLHLKRYYGRILHYLKAKEYSHCAWTIVRVEILRNFYFINRLTGYLRN

SEQ ID NO: 1213 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETKVENLLANVYHQINHLKTVLEEKLEKEDFTRGKLMSSLHLKRYYGRILHYLKAKEYSHCAWTIVRVEILRNFYFINRLTGYLRN

SEQ ID NO: 1214 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETRVENLLANVYHQINHLKTVLEEKLEKEDFTRGKLMSSLHLKRYYGRILHYLKAKEYSHCAWTIVRVEILRNFYFINRLTGYLRN

SEQ ID NO: 1215 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETNVENLLANVYHQINHLKTVLEEKLEKEDFTRGKLMSSLHLKRYYGRILHYLKAKEYSHCAWTIVRVEILRNFYFINRLTGYLRN

SEQ ID NO: 1216 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETQVENLLANVYHQINHLKTVLEEKLEKEDFTRGKLMSSLHLKRYYGRILHYLKAKEYSHCAWTIVRVEILRNFYFINRLTGYLRN

SEQ ID NO: 1217 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETSVENLLANVYHQINHLKTVLEEKLEKEDFTRGKLMSSLHLKRYYGRILHYLKAKEYSHCAWTIVRVEILRNFYFINRLTGYLRN

SEQ ID NO: 1218 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETTVENLLANVYHQINHLKTVLEEKLEKEDFTRGKLMSSLHLKRYYGRILHYLKAKEYSHCAWTIVRVEILRNFYFINRLTGYLRN

SEQ ID NO: 1219 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEDLLANVYHQINHLKTVLEEKLEKEDFTRGKLMSSLHLKRYYGRILHYLKAKEYSHCAWTIVRVEILRNFYFINRLTGYLRN

SEQ ID NO: 1220 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEELLANVYHQINHLKTVLEEKLEKEDFTRGKLMSSLHLKRYYGRILHYLKAKEYSHCAWTIVRVEILRNFYFINRLTGYLRN

SEQ ID NO: 1221 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEKLLANVYHQINHLKTVLEEKLEKEDFTRGKLMSSLHLKRYYGRILHYLKAKEYSHCAWTIVRVEILRNFYFINRLTGYLRN

SEQ ID NO: 1222 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVERLLANVYHQINHLKTVLEEKLEKEDFTRGKLMSSLHLKRYYGRILHYLKAKEYSHCAWTIVRVEILRNFYFINRLTGYLRN

SEQ ID NO: 1223 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVEQLLANVYHQINHLKTVLEEKLEKEDFTRGKLMSSLHLKRYYGRILHYLKAKEYSHCAWTIVRVEILRNFYFINRLTGYLRN

SEQ ID NO: 1224 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVESLLANVYHQINHLKTVLEEKLEKEDFTRGKLMSSLHLKRYYGRILHYLKAKEYSHCAWTIVRVEILRNFYFINRLTGYLRN

SEQ ID NO: 1225 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVETLLANVYHQINHLKTVLEEKLEKEDFTRGKLMSSLHLKRYYGRILHYLKAKEYSHCAWTIVRVEILRNFYFINRLTGYLRN

SEQ ID NO: 1226 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENDLANVYHQINHLKTVLEEKLEKEDFTRGKLMSSLHLKRYYGRILHYLKAKEYSHCAWTIVRVEILRNFYFINRLTGYLRN

SEQ ID NO: 1227 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENELANVYHQINHLKTVLEEKLEKEDFTRGKLMSSLHLKRYYGRILHYLKAKEYSHCAWTIVRVEILRNFYFINRLTGYLRN

SEQ ID NO: 1228 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENKLANVYHQINHLKTVLEEKLEKEDFTRGKLMSSLHLKRYYGRILHYLKAKEYSHCAWTIVRVEILRNFYFINRLTGYLRN

SEQ ID NO: 1229 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENRLANVYHQINHLKTVLEEKLEKEDFTRGKLMSSLHLKRYYGRILHYLKAKEYSHCAWTIVRVEILRNFYFINRLTGYLRN

SEQ ID NO: 1230 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENNLANVYHQINHLKTVLEEKLEKEDFTRGKLMSSLHLKRYYGRILHYLKAKEYSHCAWTIVRVEILRNFYFINRLTGYLRN

SEQ ID NO: 1231 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENQLANVYHQINHLKTVLEEKLEKEDFTRGKLMSSLHLKRYYGRILHYLKAKEYSHCAWTIVRVEILRNFYFINRLTGYLRN

SEQ ID NO: 1232 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENSLANVYHQINHLKTVLEEKLEKEDFTRGKLMSSLHLKRYYGRILHYLKAKEYSHCAWTIVRVEILRNFYFINRLTGYLRN

SEQ ID NO: 1233 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENTLANVYHQINHLKTVLEEKLEKEDFTRGKLMSSLHLKRYYGRILHYLKAKEYSHCAWTIVRVEILRNFYFINRLTGYLRN

SEQ ID NO: 1234 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLDNVYHQINHLKTVLEEKLEKEDFTRGKLMSSLHLKRYYGRILHYLKAKEYSHCAWTIVRVEILRNFYFINRLTGYLRN

SEQ ID NO: 1235 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLENVYHQINHLKTVLEEKLEKEDFTRGKLMSSLHLKRYYGRILHYLKAKEYSHCAWTIVRVEILRNFYFINRLTGYLRN

SEQ ID NO: 1236 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLKNVYHQINHLKTVLEEKLEKEDFTRGKLMSSLHLKRYYGRILHYLKAKEYSHCAWTIVRVEILRNFYFINRLTGYLRN

SEQ ID NO: 1237 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLRNVYHQINHLKTVLEEKLEKEDFTRGKLMSSLHLKRYYGRILHYLKAKEYSHCAWTIVRVEILRNFYFINRLTGYLRN

SEQ ID NO: 1238 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLADVYHQINHLKTVLEEKLEKEDFTRGKLMSSLHLKRYYGRILHYLKAKEYSHCAWTIVRVEILRNFYFINRLTGYLRN

SEQ ID NO: 1239 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAEVYHQINHLKTVLEEKLEKEDFTRGKLMSSLHLKRYYGRILHYLKAKEYSHCAWTIVRVEILRNFYFINRLTGYLRN

SEQ ID NO: 1240 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAKVYHQINHLKTVLEEKLEKEDFTRGKLMSSLHLKRYYGRILHYLKAKEYSHCAWTIVRVEILRNFYFINRLTGYLRN

SEQ ID NO: 1241 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLAQVYHQINHLKTVLEEKLEKEDFTRGKLMSSLHLKRYYGRILHYLKAKEYSHCAWTIVRVEILRNFYFINRLTGYLRN

SEQ ID NO: 1242 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLARVYHQINHLKTVLEEKLEKEDFTRGKLMSSLHLKRYYGRILHYLKAKEYSHCAWTIVRVEILRNFYFINRLTGYLRN

SEQ ID NO: 1243 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLASVYHQINHLKTVLEEKLEKEDFTRGKLMSSLHLKRYYGRILHYLKAKEYSHCAWTIVRVEILRNFYFINRLTGYLRN

SEQ ID NO: 1244 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLATVYHQINHLKTVLEEKLEKEDFTRGKLMSSLHLKRYYGRILHYLKAKEYSHCAWTIVRVEILRNFYFINRLTGYLRN

SEQ ID NO: 1245 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANDYHQINHLKTVLEEKLEKEDFTRGKLMSSLHLKRYYGRILHYLKAKEYSHCAWTIVRVEILRNFYFINRLTGYLRN

SEQ ID NO: 1246 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANEYHQINHLKTVLEEKLEKEDFTRGKLMSSLHLKRYYGRILHYLKAKEYSHCAWTIVRVEILRNFYFINRLTGYLRN

SEQ ID NO: 1247 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANKYHQINHLKTVLEEKLEKEDFTRGKLMSSLHLKRYYGRILHYLKAKEYSHCAWTIVRVEILRNFYFINRLTGYLRN

SEQ ID NO: 1248 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANNYHQINHLKTVLEEKLEKEDFTRGKLMSSLHLKRYYGRILHYLKAKEYSHCAWTIVRVEILRNFYFINRLTGYLRN

SEQ ID NO: 1249 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANQYHQINHLKTVLEEKLEKEDFTRGKLMSSLHLKRYYGRILHYLKAKEYSHCAWTIVRVEILRNFYFINRLTGYLRN

SEQ ID NO: 1250 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANRYHQINHLKTVLEEKLEKEDFTRGKLMSSLHLKRYYGRILHYLKAKEYSHCAWTIVRVEILRNFYFINRLTGYLRN

SEQ ID NO: 1251 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANSYHQINHLKTVLEEKLEKEDFTRGKLMSSLHLKRYYGRILHYLKAKEYSHCAWTIVRVEILRNFYFINRLTGYLRN

SEQ ID NO: 1252 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANTYHQINHLKTVLEEKLEKEDFTRGKLMSSLHLKRYYGRILHYLKAKEYSHCAWTIVRVEILRNFYFINRLTGYLRN

SEQ ID NO: 1253 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHDINHLKTVLEEKLEKEDFTRGKLMSSLHLKRYYGRILHYLKAKEYSHCAWTIVRVEILRNFYFINRLTGYLRN

SEQ ID NO: 1254 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHEINHLKTVLEEKLEKEDFTRGKLMSSLHLKRYYGRILHYLKAKEYSHCAWTIVRVEILRNFYFINRLTGYLRN

SEQ ID NO: 1255 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHKINHLKTVLEEKLEKEDFTRGKLMSSLHLKRYYGRILHYLKAKEYSHCAWTIVRVEILRNFYFINRLTGYLRN

SEQ ID NO: 1256 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHNINHLKTVLEEKLEKEDFTRGKLMSSLHLKRYYGRILHYLKAKEYSHCAWTIVRVEILRNFYFINRLTGYLRN

SEQ ID NO: 1257 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHRINHLKTVLEEKLEKEDFTRGKLMSSLHLKRYYGRILHYLKAKEYSHCAWTIVRVEILRNFYFINRLTGYLRN

SEQ ID NO: 1258 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHSINHLKTVLEEKLEKEDFTRGKLMSSLHLKRYYGRILHYLKAKEYSHCAWTIVRVEILRNFYFINRLTGYLRN

SEQ ID NO: 1259 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHTINHLKTVLEEKLEKEDFTRGKLMSSLHLKRYYGRILHYLKAKEYSHCAWTIVRVEILRNFYFINRLTGYLRN

SEQ ID NO: 1260 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQDNHLKTVLEEKLEKEDFTRGKLMSSLHLKRYYGRILHYLKAKEYSHCAWTIVRVEILRNFYFINRLTGYLRN

SEQ ID NO: 1261 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQENHLKTVLEEKLEKEDFTRGKLMSSLHLKRYYGRILHYLKAKEYSHCAWTIVRVEILRNFYFINRLTGYLRN

SEQ ID NO: 1262 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQKNHLKTVLEEKLEKEDFTRGKLMSSLHLKRYYGRILHYLKAKEYSHCAWTIVRVEILRNFYFINRLTGYLRN

SEQ ID NO: 1263 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQNNHLKTVLEEKLEKEDFTRGKLMSSLHLKRYYGRILHYLKAKEYSHCAWTIVRVEILRNFYFINRLTGYLRN

SEQ ID NO: 1264 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQQNHLKTVLEEKLEKEDFTRGKLMSSLHLKRYYGRILHYLKAKEYSHCAWTIVRVEILRNFYFINRLTGYLRN

SEQ ID NO: 1265 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQRNHLKTVLEEKLEKEDFTRGKLMSSLHLKRYYGRILHYLKAKEYSHCAWTIVRVEILRNFYFINRLTGYLRN

SEQ ID NO: 1266 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQSNHLKTVLEEKLEKEDFTRGKLMSSLHLKRYYGRILHYLKAKEYSHCAWTIVRVEILRNFYFINRLTGYLRN

SEQ ID NO: 1267 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQTNHLKTVLEEKLEKEDFTRGKLMSSLHLKRYYGRILHYLKAKEYSHCAWTIVRVEILRNFYFINRLTGYLRN

SEQ ID NO: 1268 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINDLKTVLEEKLEKEDFTRGKLMSSLHLKRYYGRILHYLKAKEYSHCAWTIVRVEILRNFYFINRLTGYLRN

SEQ ID NO: 1269 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINELKTVLEEKLEKEDFTRGKLMSSLHLKRYYGRILHYLKAKEYSHCAWTIVRVEILRNFYFINRLTGYLRN

SEQ ID NO: 1270 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINKLKTVLEEKLEKEDFTRGKLMSSLHLKRYYGRILHYLKAKEYSHCAWTIVRVEILRNFYFINRLTGYLRN

SEQ ID NO: 1271 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINNLKTVLEEKLEKEDFTRGKLMSSLHLKRYYGRILHYLKAKEYSHCAWTIVRVEILRNFYFINRLTGYLRN

SEQ ID NO: 1272 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINQLKTVLEEKLEKEDFTRGKLMSSLHLKRYYGRILHYLKAKEYSHCAWTIVRVEILRNFYFINRLTGYLRN

SEQ ID NO: 1273 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINRLKTVLEEKLEKEDFTRGKLMSSLHLKRYYGRILHYLKAKEYSHCAWTIVRVEILRNFYFINRLTGYLRN

SEQ ID NO: 1274 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINSLKTVLEEKLEKEDFTRGKLMSSLHLKRYYGRILHYLKAKEYSHCAWTIVRVEILRNFYFINRLTGYLRN

SEQ ID NO: 1275 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINTLKTVLEEKLEKEDFTRGKLMSSLHLKRYYGRILHYLKAKEYSHCAWTIVRVEILRNFYFINRLTGYLRN

SEQ ID NO: 1276 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHDKTVLEEKLEKEDFTRGKLMSSLHLKRYYGRILHYLKAKEYSHCAWTIVRVEILRNFYFINRLTGYLRN

SEQ ID NO: 1277 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHEKTVLEEKLEKEDFTRGKLMSSLHLKRYYGRILHYLKAKEYSHCAWTIVRVEILRNFYFINRLTGYLRN

SEQ ID NO: 1278 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHKKTVLEEKLEKEDFTRGKLMSSLHLKRYYGRILHYLKAKEYSHCAWTIVRVEILRNFYFINRLTGYLRN

SEQ ID NO: 1279 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHNKTVLEEKLEKEDFTRGKLMSSLHLKRYYGRILHYLKAKEYSHCAWTIVRVEILRNFYFINRLTGYLRN

SEQ ID NO: 1280 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHQKTVLEEKLEKEDFTRGKLMSSLHLKRYYGRILHYLKAKEYSHCAWTIVRVEILRNFYFINRLTGYLRN

SEQ ID NO: 1281 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHRKTVLEEKLEKEDFTRGKLMSSLHLKRYYGRILHYLKAKEYSHCAWTIVRVEILRNFYFINRLTGYLRN

SEQ ID NO: 1282 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHSKTVLEEKLEKEDFTRGKLMSSLHLKRYYGRILHYLKAKEYSHCAWTIVRVEILRNFYFINRLTGYLRN

SEQ ID NO: 1283 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHTKTVLEEKLEKEDFTRGKLMSSLHLKRYYGRILHYLKAKEYSHCAWTIVRVEILRNFYFINRLTGYLRN

SEQ ID NO: 1284 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTDLEEKLEKEDFTRGKLMSSLHLKRYYGRILHYLKAKEYSHCAWTIVRVEILRNFYFINRLTGYLRN

SEQ ID NO: 1285 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTELEEKLEKEDFTRGKLMSSLHLKRYYGRILHYLKAKEYSHCAWTIVRVEILRNFYFINRLTGYLRN

SEQ ID NO: 1286 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTKLEEKLEKEDFTRGKLMSSLHLKRYYGRILHYLKAKEYSHCAWTIVRVEILRNFYFINRLTGYLRN

SEQ ID NO: 1287 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTNLEEKLEKEDFTRGKLMSSLHLKRYYGRILHYLKAKEYSHCAWTIVRVEILRNFYFINRLTGYLRN

SEQ ID NO: 1288 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTQLEEKLEKEDFTRGKLMSSLHLKRYYGRILHYLKAKEYSHCAWTIVRVEILRNFYFINRLTGYLRN

SEQ ID NO: 1289 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTRLEEKLEKEDFTRGKLMSSLHLKRYYGRILHYLKAKEYSHCAWTIVRVEILRNFYFINRLTGYLRN

SEQ ID NO: 1290 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTSLEEKLEKEDFTRGKLMSSLHLKRYYGRILHYLKAKEYSHCAWTIVRVEILRNFYFINRLTGYLRN

SEQ ID NO: 1291 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTTLEEKLEKEDFTRGKLMSSLHLKRYYGRILHYLKAKEYSHCAWTIVRVEILRNFYFINRLTGYLRN

SEQ ID NO: 1292 - protein, 166 aa, Homo sapiens
CSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1293 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTCLEEKLEKEDFTRGKLMSSLHLKRYYGRILHYLKAKEYSHCAWTIVRVEILRNFYFINRLTGYLRN

SEQ ID NO: 1294 - protein, 166 aa, Homo sapiens
MSYNLCGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1295 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHCKTVLEEKLEKEDFTRGKLMSSLHLKRYYGRILHYLKAKEYSHCAWTIVRVEILRNFYFINRLTGYLRN

SEQ ID NO: 1296 - protein, 166 aa, Homo sapiens
MSYNLLGFLCRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1297 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINCLKTVLEEKLEKEDFTRGKLMSSLHLKRYYGRILHYLKAKEYSHCAWTIVRVEILRNFYFINRLTGYLRN

SEQ ID NO: 1298 - protein, 166 aa, Homo sapiens
MSYNLLGFLQRSCNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1299 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHCINHLKTVLEEKLEKEDFTRGKLMSSLHLKRYYGRILHYLKAKEYSHCAWTIVRVEILRNFYFINRLTGYLRN

SEQ ID NO: 1300 - protein, 166 aa, Homo sapiens
MSYNLLGFLQRSSNFCCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1301 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLACVYHQINHLKTVLEEKLEKEDFTRGKLMSSLHLKRYYGRILHYLKAKEYSHCAWTIVRVEILRNFYFINRLTGYLRN

SEQ ID NO: 1302 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANCYHQINHLKTVLEEKLEKEDFTRGKLMSSLHLKRYYGRILHYLKAKEYSHCAWTIVRVEILRNFYFINRLTGYLRN

SEQ ID NO: 1303 - protein, 165 aa, Homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELHQQLNDLEACVIQGVGVTETPLMKEDSILAVRKYFQRITLYLKEKKYSPCAWEVVRAEIMRSFSLSTNLQESLRSKE

SEQ ID NO: 1304 - protein, 10 aa, Artificial Sequence
  epitope tag
CYPYDVPDYA

SEQ ID NO: 1305 - protein, 8 aa, Artificial Sequence
  epitope tag
DYKDDDDK

SEQ ID NO: 1306 - protein, 11 aa, Artificial Sequence
  epitope tag
CEQKLISEEDL

SEQ ID NO: 1307 - protein, 5 aa, Artificial Sequence
  proteolytic cleavage site
DDDDK

SEQ ID NO: 1308 - protein, 4 aa, Artificial Sequence
  proteolytic cleavage site
IEGR

SEQ ID NO: 1309 - protein, 6 aa, Artificial Sequence
  proteolytic cleavage site
LVPRGS

SEQ ID NO: 1310 - protein, 8 aa, Artificial Sequence
  proteolytic cleavage site
HPFHLVIH

SEQ ID NO: 1311 - protein, 23 aa, Artificial Sequence
  peptide carrier
NYHDIVLALAGVCQSAKLVHQLA

SEQ ID NO: 1312 - protein, 23 aa, Artificial Sequence
  peptide carrier
NYYDITLALAGVCQAAKLVQQFA

SEQ ID NO: 1313 - protein, 23 aa, Artificial Sequence
  peptide carrier
NYYDITLALAGICQSARLVQQLA

SEQ ID NO: 1314 - protein, 23 aa, Artificial Sequence
  peptide carrier
AIYDRTIAFAGICQAVALVQQVA

SEQ ID NO: 1315 - protein, 23 aa, Artificial Sequence
  peptide carrier
KIHLITLSLAGICQSAHLVQQLA

SEQ ID NO: 1316 - protein, 23 aa, Artificial Sequence
  peptide carrier
DPRQQLIALGAVFESAALVDKLA

SEQ ID NO: 1317 - protein, 23 aa, Artificial Sequence
  peptide carrier
LIDNRVLALAGVVQALQQVRQIA

SEQ ID NO: 1318 - protein, 23 aa, Artificial Sequence
  peptide carrier
NLPPIVLAVIGICAAVFLLQQYV

SEQ ID NO: 1319 - protein, 23 aa, Artificial Sequence
  peptide carrier
NYFIVNLALADLCMAAFNAAFNF

SEQ ID NO: 1320 - protein, 23 aa, Artificial Sequence
  peptide carrier
TAFDFNKMLDGVCTYVKGVQQYL

SEQ ID NO: 1321 - protein, 23 aa, Artificial Sequence
  peptide carrier
RAILIPLALAGLCQVARAGDISS

SEQ ID NO: 1322 - protein, 25 aa, Artificial Sequence
  peptide carrier
MRNLTKTSLLLAGLCTAAQMVFVTH

SEQ ID NO: 1323 - protein, 25 aa, Artificial Sequence
  peptide carrier
IELMIVIAIIGILAAIALPAYQEYV

SEQ ID NO: 1324 - protein, 25 aa, Artificial Sequence
  peptide carrier
IELMIVIAIIGILAAIALPAYQDYV

SEQ ID NO: 1325 - protein, 16 aa, Artificial Sequence
  peptide carrier
ASFGFCIGRLCVQDGF

SEQ ID NO: 1326 - protein, 23 aa, Artificial Sequence
  peptide carrier
NYFLVNLAFAEASMAAFNTVVNF

SEQ ID NO: 1327 - protein, 24 aa, Artificial Sequence
  peptide carrier
MNYYDITLALAGICQSARLVQQLA

SEQ ID NO: 1328 - protein, 23 aa, Artificial Sequence
  peptide carrier
MYYDITLALAGICQSARLVQQLA

SEQ ID NO: 1329 - protein, 22 aa, Artificial Sequence
  peptide carrier
MYDITLALAGICQSARLVQQLA

SEQ ID NO: 1330 - protein, 23 aa, Artificial Sequence
  peptide carrier
MRNLTRTSLLLAGLCTAAQMVFV

SEQ ID NO: 1331 - protein, 23 aa, Artificial Sequence
  peptide carrier
NYHDIVLALAGVCQSARLVHQLA

SEQ ID NO: 1332 - protein, 6 aa, Artificial Sequence
  linker
AAAGGM

SEQ ID NO: 1333 - protein, 14 aa, Artificial Sequence
  linker
AAAGGMPPAAAGGM

SEQ ID NO: 1334 - protein, 6 aa, Artificial Sequence
  linker
AAAGGM

SEQ ID NO: 1335 - protein, 9 aa, Artificial Sequence
  linker
PPAAAGGMM

SEQ ID NO: 1336 - protein, 4 aa, Artificial Sequence
  linker
IEGR

SEQ ID NO: 1337 - protein, 6 aa, Artificial Sequence
  linker
GGKGGK

SEQ ID NO: 1338 - DNA, 92 bp, Artificial Sequence
  primer
agcttgccaccatgtgcgacctgccccagacccacagcctgggcaaccgccgcgccctgatcctgctggcccagatgcgccgcatcagcccc

SEQ ID NO: 1339 - DNA, 79 bp, Artificial Sequence
  primer
gcggcgcatctgggccagcaggatcagggcgcggcggttgcccaggctgtgggtctggggcaggtcgcacatggtggca

SEQ ID NO: 1340 - DNA, 88 bp, Artificial Sequence
  primer
ttcagctgcctgaaggaccgccacgacttcggcttcccccaggaggagttcgacggcaaccagttccagaaggcccaggccatcagcg

SEQ ID NO: 1341 - DNA, 88 bp, Artificial Sequence
  primer
cctgggccttctggaactggttgccgtcgaactcctcctgggggaagccgaagtcgtggcggtccttcaggcagctgaaggggctgat

SEQ ID NO: 1342 - DNA, 86 bp, Artificial Sequence
  primer
tgctgcacgagatgatccagcagaccttcaacctgttcagcaccaaggacagcagcgccgcctgggacgagagcctgctggagaag

SEQ ID NO: 1343 - DNA, 85 bp, Artificial Sequence
  primer
aggctctcgtcccaggcggcgctgctgtccttggtgctgaacaggttgaaggtctgctggatcatctcgtgcagcacgctgatgg

SEQ ID NO: 1344 - DNA, 91 bp, Artificial Sequence
  primer
ttctacaccgagctgtaccagcagctgaacgacctggaggcctgcgtgatccaggaggtgggcgtggaggagacccccctgatgaacgtgg

SEQ ID NO: 1345 - DNA, 92 bp, Artificial Sequence
  primer
tcaggggggtctcctccacgcccacctcctggatcacgcaggcctccaggtcgttcagctgctggtacagctcggtgtagaacttctccagc

SEQ ID NO: 1346 - DNA, 87 bp, Artificial Sequence
  primer
acagcatcctggccgtgaagaagtacttccagcgcatcaccctgtacctgaccgagaagaagtacagcccctgcgcctgggaggtgg

SEQ ID NO: 1347 - DNA, 87 bp, Artificial Sequence
  primer
aggcgcaggggctgtacttcttctcggtcaggtacagggtgatgcgctggaagtacttcttcacggccaggatgctgtccacgttca

SEQ ID NO: 1348 - DNA, 75 bp, Artificial Sequence
  primer
tgcgcgccgagatcatgcgcagcttcagcctgagcaccaacctgcaggagcgcctgcgccgcaaggagtaatgag

SEQ ID NO: 1349 - DNA, 88 bp, Artificial Sequence
  primer
aattctcattactccttgcggcgcaggcgctcctgcaggttggtgctcaggctgaagctgcgcatgatctcggcgcgcaccacctccc

SEQ ID NO: 1350 - DNA, 66 bp, Artificial Sequence
  primer
gccctggtggtgctgagctgcaagagcagctgcagcctgggctgcgacctgccccagacccacagc

SEQ ID NO: 1351 - DNA, 67 bp, Artificial Sequence
  primer
tataaagcttgccaccatggccctgcccttcgccctgatgatggccctggtggtgctgagctgcaag

SEQ ID NO: 1352 - DNA, 66 bp, Artificial Sequence
  primer
gccctgctgctgtgcttcagcaccaccgccctgagcatgagctgcgacctgccccagacccacagc

SEQ ID NO: 1353 - DNA, 67 bp, Artificial Sequence
  primer
tataaagcttgccaccatgaccaacaagtgcctgctgcagatcgccctgctgctgtgcttcagcacc

SEQ ID NO: 1354 - DNA, 34 bp, Artificial Sequence
  primer
tatagaattctcattactccttgcggcgcaggcg

SEQ ID NO: 1355 - protein, 183 aa, Artificial Sequence
  synthetic interferon
MALFALLALVTSSSSLGCDLPQTHSLGSRRTLMLLAQMRRISPFSCLKDRHDFGFPQEEFDGNQFQKAQAISVLHEMLQQIFNLFSTKDSSAAWDETLLEKFYTELYQQLNDLEACVIQEVGVEETPLMNEDSILAVKKYFQRITLYLKEKKYSPCAWEVVRAEIMRSFSLSTNLQERLRSKD

SEQ ID NO: 1356 - protein, 167 aa, Artificial Sequence
  consensus interferon
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1357 - protein, 166 aa, Homo Sapiens [sequence omitted]

SEQ ID NO: 1358 - protein, 189 aa, Homo Sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSFSFSTNLQKRLRRKD

SEQ ID NO: 1359 - protein, 187 aa, Homo Sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1360 - protein, 195 aa, Homo Sapiens
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 1361 - protein, 60 aa, Artificial Sequence
  synthetic interferon
MIQQTFNLFSTKDSSAAWDESLLEKFYTELYQQLNDLEACVIQEVGVTETPLMNVDSILA

SEQ ID NO: 1362 - protein, 60 aa, Artificial Sequence
  consensus interferon
MIQQTFNLFSTKDSSAAWDESLLEKFYTELYQQLNDLEACVIQEVGVEETPLMNVDSILA

SEQ ID NO: 1363 - protein, 60 aa, Artificial Sequence
  variant interferon
MIQQTFNLFSTKNSSAAWDESLLEKFYTELYQQLNDLEACVIQEVGVEETPLMNVDSILA

SEQ ID NO: 1364 - protein, 60 aa, Artificial Sequence
  variant interferon
MIQQTFNLFSTKDSSAAWNESLLEKFYTELYQQLNDLEACVIQEVGVEETPLMNVDSILA

SEQ ID NO: 1365 - protein, 60 aa, Artificial Sequence; identical to SEQ ID NO: 1361
  variant interferon

SEQ ID NO: 1366 - protein, 60 aa, Artificial Sequence
  variant interferon
MIQQTFNLFSTKDSSAAWDESLLEKFYTELYQQLNDLEACVIQEVGVNETPLMNVDSILA

SEQ ID NO: 1367 - protein, 60 aa, Artificial Sequence
  variant interferon
MIQQTFNLFSTKNSSAAWNESLLEKFYTELYQQLNDLEACVIQEVGVEETPLMNVDSILA

SEQ ID NO: 1368 - protein, 60 aa, Artificial Sequence
  variant interferon
MIQQTFNLFSTKNSSAAWDESLLEKFYTELYQQLNDLEACVIQEVGVTETPLMNVDSILA

SEQ ID NO: 1369 - protein, 60 aa, Artificial Sequence
  variant interferon
MIQQTFNLFSTKDSSAAWNESLLEKFYTELYQQLNDLEACVIQEVGVTETPLMNVDSILA

SEQ ID NO: 1370 - protein, 60 aa, Artificial Sequence
  variant interferon
MIQQTFNLFSTKNSSAAWDESLLEKFYTELYQQLNDLEACVIQEVGVNETPLMNVDSILA

SEQ ID NO: 1371 - protein, 60 aa, Artificial Sequence
  variant interferon
MIQQTFNLFSTKDSSAAWNESLLEKFYTELYQQLNDLEACVIQEVGVNETPLMNVDSILA

SEQ ID NO: 1372 - protein, 60 aa, Artificial Sequence
  variant interferon
MIQQTFNLFSTKNSSAAWNESLLEKFYTELYQQLNDLEACVIQEVGVTETPLMNVDSILA

SEQ ID NO: 1373 - protein, 60 aa, Artificial Sequence
  variant interferon
MIQQTFNLFSTKNSSAAWNESLLEKFYTELYQQLNDLEACVIQEVGVNETPLMNVDSILA

SEQ ID NO: 1374 - DNA, 120 bp, Artificial Sequence
  synthetic interferon
aggacagcagcgccgcctgggacgagagcctgctggagaagttctacaccgagctgtaccagcagctgaacgacctggaggcctgcgtgatccaggaggtgggcgtgaacgagacccccc

SEQ ID NO: 1375 - DNA, 120 bp, Artificial Sequence
  consensus interferon
aggacagcagcgccgcctgggacgagagcctgctggagaagttctacaccgagctgtaccagcagctgaacgacctggaggcctgcgtgatccaggaggtgggcgtggaggagacccccc

SEQ ID NO: 1376 - DNA, 120 bp, Artificial Sequence
  variant interferon
agaacagcagcgccgcctgggacgagagcctgctggagaagttctacaccgagctgtaccagcagctgaacgacctggaggcctgcgtgatccaggaggtgggcgtggaggagacccccc

SEQ ID NO: 1377 - DNA, 120 bp, Artificial Sequence
  variant interferon
aggacagcagcgccgcctggaacgagagcctgctggagaagttctacaccgagctgtaccagcagctgaacgacctggaggcctgcgtgatccaggaggtgggcgtggaggagacccccc

SEQ ID NO: 1378 - DNA, 120 bp, Artificial Sequence; identical to SEQ ID NO: 1374
  variant interferon

SEQ ID NO: 1379 - DNA, 120 bp, Artificial Sequence
  variant interferon
aggacagcagcgccgcctgggacgagagcctgctggagaagttctacaccgagctgtaccagcagctgaacgacctggaggcctgcgtgatccaggaggtgggcgtgaccgagacccccc

SEQ ID NO: 1380 - DNA, 120 bp, Artificial Sequence
  variant interferon
agaacagcagcgccgcctggaacgagagcctgctggagaagttctacaccgagctgtaccagcagctgaacgacctggaggcctgcgtgatccaggaggtgggcgtggaggagacccccc

SEQ ID NO: 1381 - DNA, 120 bp, Artificial Sequence
  variant interferon
agaacagcagcgccgcctgggacgagagcctgctggagaagttctacaccgagctgtaccagcagctgaacgacctggaggcctgcgtgatccaggaggtgggcgtgaacgagacccccc

SEQ ID NO: 1382 - DNA, 120 bp, Artificial Sequence
  variant interferon
agaacagcagcgccgcctgggacgagagcctgctggagaagttctacaccgagctgtaccagcagctgaacgacctggaggcctgcgtgatccaggaggtgggcgtgaccgagacccccc

SEQ ID NO: 1383 - DNA, 120 bp, Artificial Sequence
  variant interferon
aggacagcagcgccgcctggaacgagagcctgctggagaagttctacaccgagctgtaccagcagctgaacgacctggaggcctgcgtgatccaggaggtgggcgtgaacgagacccccc

SEQ ID NO: 1384 - DNA, 120 bp, Artificial Sequence
  variant interferon
aggacagcagcgccgcctggaacgagagcctgctggagaagttctacaccgagctgtaccagcagctgaacgacctggaggcctgcgtgatccaggaggtgggcgtgaccgagacccccc

SEQ ID NO: 1385 - DNA, 120 bp, Artificial Sequence
  variant interferon
agaacagcagcgccgcctggaacgagagcctgctggagaagttctacaccgagctgtaccagcagctgaacgacctggaggcctgcgtgatccaggaggtgggcgtgaacgagacccccc

SEQ ID NO: 1386 - DNA, 120 bp, Artificial Sequence
  variant interferon
agaacagcagcgccgcctggaacgagagcctgctggagaagttctacaccgagctgtaccagcagctgaacgacctggaggcctgcgtgatccaggaggtgggcgtgaccgagacccccc

SEQ ID NO: 1387 - protein, 189 aa, Artificial Sequence
  synthetic interferon
MALKFALQIALVVLSSTSALSLGCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1388 - protein, 189 aa, Artificial Sequence
  variant interferon
MALPFALMMALVVLSCKSSCSLGCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1389 - protein, 189 aa, Artificial Sequence
  variant interferon
MTNKCLLQIALLLCFSTTALSMSCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1390 - protein, 60 aa, Artificial Sequence
  synthetic interferon
YEMLQNIFAIFRQDSSSTGWNETIVENLLANVYHQINHLKTVLEEKLEKTDFTRGKLMSS

SEQ ID NO: 1391 - protein, 60 aa, Homo sapiens
YEMLQNIFAIFRQDSSSTGWNETIVENLLANVYHQINHLKTVLEEKLEKEDFTRGKLMSS

SEQ ID NO: 1392 - protein, 60 aa, Artificial Sequence
  variant interferon
YEMLQNIFAIFRQDNSSTGWNETIVENLLANVYHQINHLKTVLEEKLEKEDFTRGKLMSS

SEQ ID NO: 1393 - protein, 60 aa, Artificial Sequence; identical to SEQ ID NO: 1390
  variant interferon

SEQ ID NO: 1394 - protein, 60 aa, Artificial Sequence
  variant interferon
YEMLQNIFAIFRQDSSSTGWNETIVENLLANVYHQINHLKTVLEEKLEKNDTTRGKLMSS

SEQ ID NO: 1395 - protein, 60 aa, Artificial Sequence
  variant interferon
YEMLQNIFAIFRQDNSSTGWNETIVENLLANVYHQINHLKTVLEEKLEKTDFTRGKLMSS

SEQ ID NO: 1396 - protein, 60 aa, Artificial Sequence
  variant interferon
YEMLQNIFAIFRQDNSSTGWNETIVENLLANVYHQINHLKTVLEEKLEKNDTTRGKLMSS

SEQ ID NO: 1397 - protein, 60 aa, Artificial Sequence
  synthetic interferon
HEMLQQIFSLFHTENSSAAWNMTLLDQLHTGLHQQLQHLETCLLQVVGEGESAGAISSPA

SEQ ID NO: 1398 - protein, 60 aa, Homo sapiens
HEMLQQIFSLFHTERSSAAWNMTLLDQLHTGLHQQLQHLETCLLQVVGEGESAGAISSPA

SEQ ID NO: 1399 - protein, 60 aa, Artificial Sequence; identical to SEQ ID NO: 1397
  variant interferon

SEQ ID NO: 1400 - protein, 60 aa, Artificial Sequence
  variant interferon
HEMLQQIFSLFHTERSSAAWNMTLLDQLHTGLHQQLQHLETCLLQVVGETESAGAISSPA

SEQ ID NO: 1401 - protein, 60 aa, Artificial Sequence
  variant interferon
HEMLQQIFSLFHTERSSAAWNMTLLDQLHTGLHQQLQHLETCLLQVVGENESAGAISSPA

SEQ ID NO: 1402 - protein, 60 aa, Artificial Sequence
  variant interferon
HEMLQQIFSLFHTENSSAAWNMTLLDQLHTGLHQQLQHLETCLLQVVGENESAGAISSPA

SEQ ID NO: 1403 - protein, 60 aa, Artificial Sequence
  variant interferon
HEMLQQIFSLFHTENSSAAWNMTLLDQLHTGLHQQLQHLETCLLQVVGETESAGAISSPA

SEQ ID NO: 1404 - protein, 143 aa, Homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 1405 - protein, 191 aa, Homo sapiens
FPTIPLSRLFDNAMLRARRLYQLAYDTYQEFGEAYILKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1406 - protein, 189 aa, H. sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1407 - protein, 189 aa, artificial sequence
  IFN-alpha1(31)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1408 - protein, 189 aa, artificial sequence
  IFN-alpha1(102)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1409 - protein, 189 aa, artificial sequence
  IFN-alpha1(108)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1410 - protein, 189 aa, artificial sequence
  IFN-alpha1(138)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1411 - protein, 189 aa, artificial sequence
  IFN-alpha1(31,102)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1412 - protein, 189 aa, artificial sequence
  IFN-alpha1(31,108)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1413 - protein, 189 aa, artificial sequence
  IFN-alpha1(31,138)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1414 - protein, 189 aa, artificial sequence
  IFN-alpha1(102,108)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1415 - protein, 189 aa, artificial sequence
  IFN-alpha1(102,138)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1416 - protein, 189 aa, artificial sequence
  IFN-alpha1(108,138)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1417 - protein, 189 aa, artificial sequence
  IFN-alpha1(31,102,108)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1418 - protein, 189 aa, artificial sequence
  IFN-alpha1(31,102,138)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1419 - protein, 189 aa, artificial sequence
  IFN-alpha1(31,108,138)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1420 - protein, 189 aa, artificial sequence
  IFN-alpha1(102,108,138)
MASPFALLMVLVVLSCKSSCSLGCDLPETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1421 - protein, 189 aa, artificial sequence
  IFN-alpha1(31,102,108,138)
MASPFALLMVLVVLSCKSSCSLGCNLSETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1422 - protein, 188 aa, H. sapiens [sequence omitted]

SEQ ID NO: 1423 - protein, 188 aa, artificial sequence
  IFN-alpha 2a(31)
MALTFALLVALLVLSCKSSCSVGCNLSQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1424 - protein, 188 aa, artificial sequence
  IFN-alpha 2a(102)
MALTFALLVALLVLSCKSSCSVGCDLPQTHSLGSRRTLMLLAQMRKISLFSCLKDRHDFGFPQEEFGNQFQKAETIPVLHEMIQQIFNLFSTKNSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1425 - protein, 188 aa, artificial sequence
  IFN-alpha 2a(108)
MALTFALLVALLVLSCKSSCSVGCDLPQTHSLGSRRTLMLLAQMRKISLFSCLKDRHDFGFPQEEFGNQFQKAETIPVLHEMIQQIFNLFSTKDSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1426 - skipped

SEQ ID NO: 1427 - protein, 188 aa, artificial sequence
  IFN-alpha 2a(31,102)
MALTFALLVALLVLSCKSSCSVGCNLSQTHSLGSRRTLMLLAQMRKISLFSCLKDRHDFGFPQEEFGNQFQKAETIPVLHEMIQQIFNLFSTKNSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1428 - protein, 188 aa, artificial sequence
  IFN-alpha 2a(31,108)
MALTFALLVALLVLSCKSSCSVGCNLSQTHSLGSRRTLMLLAQMRKISLFSCLKDRHDFGFPQEEFGNQFQKAETIPVLHEMIQQIFNLFSTKDSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1429 - skipped

SEQ ID NO: 1430 - protein, 188 aa, artificial sequence
  IFN-alpha 2a(102,108)
MALTFALLVALLVLSCKSSCSVGCDLPQTHSLGSRRTLMLLAQMRKISLFSCLKDRHDFGFPQEEFGNQFQKAETIPVLHEMIQQIFNLFSTKNSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1431-1432 - skipped (2 entries)

SEQ ID NO: 1433 - protein, 188 aa, artificial sequence
  IFN-alpha 2a(31,102,108)
MALTFALLVALLVLSCKSSCSVGCNLSQTHSLGSRRTLMLLAQMRKISLFSCLKDRHDFGFPQEEFGNQFQKAETIPVLHEMIQQIFNLFSTKNSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1434-1437 - skipped (4 entries)

SEQ ID NO: 1438 - protein, 188 aa, H. sapiens
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1439 - protein, 188 aa, artificial sequence
  IFN-alpha 2b (31)
MALTFALLVALLVLSCKSSCSVGCNLSQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1440 - protein, 188 aa, artificial sequence
  IFN-alpha 2b (102)
MALTFALLVALLVLSCKSSCSVGCDLPQTHSLGSRRTLMLLAQMRRISLFSCLKDRHDFGFPQEEFGNQFQKAETIPVLHEMIQQIFNLFSTKNSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1441 - protein, 188 aa, artificial sequence
  IFN-alpha 2b (108)
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1442 - skipped

SEQ ID NO: 1443 - protein, 188 aa, artificial sequence
  IFN-alpha 2b (31,102)
MALTFALLVALLVLSCKSSCSVGCNLSQTHSLGSRRTLMLLAQMRRISLFSCLKDRHDFGFPQEEFGNQFQKAETIPVLHEMIQQIFNLFSTKNSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1444 - protein, 188 aa, artificial sequence
  IFN-alpha 2b (31,108)
MALTFALLVALLVLSCKSSCSVGCNLSQTHSLGSRRTLMLLAQMRRISLFSCLKDRHDFGFPQEEFGNQFQKAETIPVLHEMIQQIFNLFSTKDSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1445 - skipped

SEQ ID NO: 1446 - protein, 188 aa, artificial sequence
  IFN-alpha 2b (102,108)
MALTFALLVALLVLSCKSSCSVGCDLPQTHSLGSRRTLMLLAQMRRISLFSCLKDRHDFGFPQEEFGNQFQKAETIPVLHEMIQQIFNLFSTKNSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1447-1448 - skipped (2 entries)

SEQ ID NO: 1449 - protein, 188 aa, artificial sequence
  IFN-alpha 2b (31,102,108)
MALTFALLVALLVLSCKSSCSVGCNLSQTHSLGSRRTLMLLAQMRRISLFSCLKDRHDFGFPQEEFGNQFQKAETIPVLHEMIQQIFNLFSTKNSSAAWNETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1450-1453 - skipped (4 entries)

SEQ ID NO: 1454 - protein, 189 aa, H. sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1455 - protein, 189 aa, artificial sequence
  IFN-alpha 4a (31)
MALSFSLLMAVLVLSYKSICSLGCNLSQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1456 - protein, 189 aa, artificial sequence
  IFN-alpha 4a (102)
MALSFSLLMAVLVLSYKSICSLGCDLPQTHSLGNRRALILLAQMGRISHFSCLKDRHDFGFPEEEFDGHQFQKAQAISVLHEMIQQTFNLFSTENSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1457 - protein, 189 aa, artificial sequence
  IFN-alpha 4a (31)
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWNQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1458 - protein, 189 aa, artificial sequence
  IFN-alpha 4a (138)
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1459 - protein, 189 aa, artificial sequence
  IFN-alpha 4a (31,102)
MALSFSLLMAVLVLSYKSICSLGCNLSQTHSLGNRRALILLAQMGRISHFSCLKDRHDFGFPEEEFDGHQFQKAQAISVLHEMIQQTFNLFSTENSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1460 - protein, 189 aa, artificial sequence
  IFN-alpha 4a (31,108)
MALSFSLLMAVLVLSYKSICSLGCNLSQTHSLGNRRALILLAQMGRISHFSCLKDRHDFGFPEEEFDGHQFQKAQAISVLHEMIQQTFNLFSTEDSSAAWNQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1461 - protein, 189 aa, artificial sequence
  IFN-alpha 4a (31,138)
MALSFSLLMAVLVLSYKSICSLGCNLSQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1462 - protein, 189 aa, artificial sequence
  IFN-alpha 4a (102,108)
MALSFSLLMAVLVLSYKSICSLGCDLPQTHSLGNRRALILLAQMGRISHFSCLKDRHDFGFPEEEFDGHQFQKTQAISVLHEMIQQTFNLFSTENSSAAWNQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1463 - protein, 189 aa, artificial sequence
  IFN-alpha 4a (102,138)
MALSFSLLMAVLVLSYKSICSLGCDLPQTHSLGNRRALILLAQMGRISHFSCLKDRHDFGFPEEEFDGHQFQKAQAISVLHEMIQQTFNLFSTENSSAAWEQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1464 - protein, 189 aa, artificial sequence
  IFN-alpha 4a (108,138)
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWNQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1465 - protein, 189 aa, artificial sequence
  IFN-alpha 4a (31,102,108)
MALSFSLLMAVLVLSYKSICSLGCNLSQTHSLGNRRALILLAQMGRISHFSCLKDRHDFGFPEEEFDGHQFQKAQAISVLHEMIQQTFNLFSTENSSAAWNQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1466 - protein, 189 aa, artificial sequence
  IFN-alpha 4a (31,102,138)
MALSFSLLMAVLVLSYKSICSLGCNLSQTHSLGNRRALILLAQMGRISHFSCLKDRHDFGFPEEEFDGHQFQKAQAISVLHEMIQQTFNLFSTENSSAAWEQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1467 - protein, 189 aa, artificial sequence
  IFN-alpha 4a (31,108,138)
MALSFSLLMAVLVLSYKSICSLGCNLSQTHSLGNRRALILLAQMGRISHFSCLKDRHDFGFPEEEFDGHQFQKAQAISVLHEMIQQTFNLFSTEDSSAAWNQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1468 - protein, 189 aa, artificial sequence
  IFN-alpha 4a (102,108,138)
MALSFSLLMAVLVLSYKSICSLGCDLPQTHSLGNRRALILLAQMGRISHFSCLKDRHDFGFPEEEFDGHQFQKAQAISVLHEMIQQTFNLFSTENSSAAWNQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1469 - protein, 189 aa, artificial sequence
  IFN-alpha 4a (31,102,108,138)
MALSFSLLMAVLVLSYKSICSLGCNLSQTHSLGNRRALILLAQMGRISHFSCLKDRHDFGFPEEEFDGHQFQKAQAISVLHEMIQQTFNLFSTENSSAAWNQSLLEKFSTELYQQLNDLEACVIQEVGVTETPLMNEDSILAVRKYFQRITLYLTEKKYSPCAWEVVRAEIMRSLSFSTNLQKRLRRKD

SEQ ID NO: 1470 - protein, 189 aa, H. sapiens [sequence omitted]

SEQ ID NO: 1471 - protein, 189 aa, artificial sequence
  IFN-alpha 4b (31)
MALSFSLLMAVLVLSYKSICSLGCNLSQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1472 - protein, 189 aa, artificial sequence
  IFN-alpha 4b (102)
MALSFSLLMAVLVLSYKSICSLGCDLPQTHSLGNRRALILLAQMGRISHFSCLKDRHDFGFPEEEFDGHQFQKTQAISVLHEMIQQTFNLFSTENSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1473 - protein, 189 aa, artificial sequence
  IFN-alpha 4b (108)
MALSFSLLMAVLVLSYKSICSLGCDLPQTHSLGNRRALILLAQMGRISHFSCLKDRHDFGFPEEEFDGHQFQKTQAISVLHEMIQQTFNLFSTEDSSAAWNQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1474 - protein, 189 aa, artificial sequence
  IFN-alpha 4b (138)
MALSFSLLMAVLVLSYKSICSLGCDLPQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1475 - protein, 189 aa, artificial sequence
  IFN-alpha 4b (31,102)
MALSFSLLMAVLVLSYKSICSLGCNLSQTHSLGNRRALILLAQMGRISHFSCLKDRHDFGFPEEEFDGHQFQKTQAISVLHEMIQQTFNLFSTENSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1476 - protein, 189 aa, artificial sequence
  IFN-alpha 4b (31,108)
MALSFSLLMAVLVLSYKSICSLGCNLSQTHSLGNRRALILLAQMGRISHFSCLKDRHDFGFPEEEFDGHQFQKTQAISVLHEMIQQTFNLFSTEDSSAAWNQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1477 - protein, 189 aa, artificial sequence
  IFN-alpha 4b (31,138)
MALSFSLLMAVLVLSYKSICSLGCNLSQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1478 - protein, 189 aa, artificial sequence
  IFN-alpha 4b (102,108)
MALSFSLLMAVLVLSYKSICSLGCDLPQTHSLGNRRALILLAQMGRISHFSCLKDRHDFGFPEEEFDGHQFQKAQAISVLHEMIQQTFNLFSTENSSAAWNQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 1479 - protein, 189 aa, artificial sequence
  IFN-alpha 4b (102,138)
MALSFSLLMAVLVLSYKSICSLGCDLPQTHSLGNRRALILLAQMGRISHFSCLKDRHDFGFPEEEFDGHQFQKTQAISVLHEMIQQTFNLFSTENSSAAWEQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1480 - protein, 189 aa, artificial sequence
  IFN-alpha 4b (108,138)
MALSFSLLMAVLVLSYKSICSLGCDLPQTHSLGNRRALILLAQMGRISHFSCLKDRHDFGFPEEEFDGHQFQKTQAISVLHEMIQQTFNLFSTEDSSAAWNQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1481 - protein, 189 aa, artificial sequence
  IFN-alpha 4b (31,102,108)
MALSFSLLMAVLVLSYKSICSLGCNLSQTHSLGNRRALILLAQMGRISHFSCLKDRHDFGFPEEEFDGHQFQKTQAISVLHEMIQQTFNLFSTENSSAAWNQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 1482 - protein, 189 aa, artificial sequence
  IFN-alpha 4b (31,102,138)
MALSFSLLMAVLVLSYKSICSLGCNLSQTHSLGNRRALILLAQMGRISHFSCLKDRHDFGFPEEEFDGHQFQKTQAISVLHEMIQQTFNLFSTENSSAAWEQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1483 - protein, 189 aa, artificial sequence
  IFN-alpha 4b (31,108,138)
MALSFSLLMAVLVLSYKSICSLGCNLSQTHSLGNRRALILLAQMGRISHFSCLKDRHDFGFPEEEFDGHQFQKTQAISVLHEMIQQTFNLFSTEDSSAAWNQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1484 - protein, 189 aa, artificial sequence
  IFN-alpha 4b (102,108,138)
MALSFSLLMAVLVLSYKSICSLGCDLPQTHSLGNRRALILLAQMGRISHFSCLKDRHDFGFPEEEFDGHQFQKTQAISVLHEMIQQTFNLFSTENSSAAWNQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1485 - protein, 189 aa, artificial sequence
  IFN-alpha 4b (31,102,108,138)
MALSFSLLMAVLVLSYKSICSLGCNLSQTHSLGNRRALILLAQMGRISHFSCLKDRHDFGFPEEEFDGHQFQKTQAISVLHEMIQQTFNLFSTENSSAAWNQSLLEKFSTELYQQLNDLEACVIQEVGVTETPLMNVDSILAVRKYFQRITLYLTEKKYSPCAWEVVRAEIMRSLSFSTNLQKRLRRKD

SEQ ID NO: 1486 - protein, 189 aa, H. sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1487 - protein, 189 aa, artificial sequence
  IFN-alpha 5 (31)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1488 - protein, 189 aa, artificial sequence
  IFN-alpha 5 (102)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKNSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1489 - protein, 189 aa, artificial sequence
  IFN-alpha 5 (108)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWNETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1490 - protein, 189 aa, artificial sequence
  IFN-alpha 5 (138)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1491 - protein, 189 aa, artificial sequence
  IFN-alpha 5 (31,102)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKNSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1492 - protein, 189 aa, artificial sequence
  IFN-alpha 5 (31,108)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKDSSATWNETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1493 - protein, 189 aa, artificial sequence
  IFN-alpha 5 (31,138)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1494 - protein, 189 aa, artificial sequence
  IFN-alpha 5 (102,108)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKNSSATWNETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1495 - protein, 189 aa, artificial sequence
  IFN-alpha 5 (102,138)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKNSSATWDETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1496 - protein, 189 aa, artificial sequence
  IFN-alpha 5 (108,138)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWNETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1497 - protein, 189 aa, artificial sequence
  IFN-alpha 5 (31,102,108)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKNSSATWNETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 1498 - protein, 189 aa, artificial sequence
  IFN-alpha 5 (31,102,138)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKNSSATWDETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1499 - protein, 189 aa, artificial sequence
  IFN-alpha 5 (31,108,138)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKDSSATWNETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1500 - protein, 189 aa, artificial sequence
  IFN-alpha 5 (102,108,138)
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKNSSATWNETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1501 - protein, 189 aa, artificial sequence
  IFN-alpha 5 (31,102,108,138)
MALPFVLLMALVVLNCKSICSLGCNLSQTHSLSNRRTLMIMAQMGRISPFSCLKDRHDFGFPQEEFDGNQFQKAQAISVLHEMIQQTFNLFSTKNSSATWNETLLDKFYTELYQQLNDLEACMMQEVGVTDTPLMNVDSILTVRKYFQRITLYLTEKKYSPCAWEVVRAEIMRSFSLSANLQERLRRKE

SEQ ID NO: 1502 - protein, 189 aa, H. sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1503 - protein, 189 aa, artificial sequence
  IFN-alpha 6 (31)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1504 - protein, 189 aa, artificial sequence
  IFN-alpha 6 (102)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKNSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1505 - protein, 189 aa, artificial sequence
  IFN-alpha 6 (108)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWNETLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1506 - protein, 189 aa, artificial sequence
  IFN-alpha 6 (138)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1507 - protein, 189 aa, artificial sequence
  IFN-alpha 6 (31,102)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKNSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1508 - protein, 189 aa, artificial sequence
  IFN-alpha 6 (31,108)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKDSSVAWNETLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1509 - protein, 189 aa, artificial sequence
  IFN-alpha 6 (31,138)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1510 - protein, 189 aa, artificial sequence
  IFN-alpha 6 (102,108)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKNSSVAWNETLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1511 - protein, 189 aa, artificial sequence
  IFN-alpha 6 (102,138)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKNSSVAWDERLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1512 - protein, 189 aa, artificial sequence
  IFN-alpha 6 (108,138)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWNETLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1513 - protein, 189 aa, artificial sequence
  IFN-alpha 6 (31,102,108)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKNSSVAWNETLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 1514 - protein, 189 aa, artificial sequence
  IFN-alpha 6 (31,102,138)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKNSSVAWDERLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1515 - protein, 189 aa, artificial sequence
  IFN-alpha 6 (31,108,138)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKDSSVAWNETLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1516 - protein, 189 aa, artificial sequence
  IFN-alpha 6 (102,108,138)
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKNSSVAWNETLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1517 - protein, 189 aa, artificial sequence
  IFN-alpha 6 (31,102,108,138)
MALPFALLMALVVLSCKSSCSLDCNLSQTHSLGHRRTMMLLAQMRRISLFSCLKDRHDFRFPQEEFDGNQFQKAEAISVLHEVIQQTFNLFSTKNSSVAWNETLLDKLYTELYQQLNDLEACVMQEVWVTGTPLMNEDSILAVRKYFQRITLYLTEKKYSPCAWEVVRAEIMRSFSSSRNLQERLRRKE

SEQ ID NO: 1518 - protein, 189 aa, H. sapiens
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1519 - protein, 189 aa, artificial sequence
  IFN-alpha 7 (31)
MARSFSLLMVVLVLSYKSICSLGCNLSQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1520 - protein, 189 aa, artificial sequence
  IFN-alpha 7 (102)
MARSFSLLMVVLVLSYKSICSLGCDLPQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1521 - protein, 189 aa, artificial sequence
  IFN-alpha 7 (108)
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1522 - protein, 189 aa, artificial sequence
  IFN-alpha 7 (138)
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1523 - protein, 189 aa, artificial sequence
  IFN-alpha 7 (31,102)
MARSFSLLMVVLVLSYKSICSLGCNLSQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1524 - protein, 189 aa, artificial sequence
  IFN-alpha 7 (31,108)
MARSFSLLMVVLVLSYKSICSLGCNLSQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1525 - protein, 189 aa, artificial sequence
  IFN-alpha 7 (31,138)
MARSFSLLMVVLVLSYKSICSLGCNLSQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1526 - protein, 189 aa, artificial sequence
  IFN-alpha 7 (102,108)
MARSFSLLMVVLVLSYKSICSLGCDLPQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1527 - protein, 189 aa, artificial sequence
  IFN-alpha 7 (102,138)
MARSFSLLMVVLVLSYKSICSLGCDLPQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1528 - protein, 189 aa, artificial sequence
  IFN-alpha 7 (108,138)
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1529 - protein, 189 aa, artificial sequence
  IFN-alpha 7 (31,102,108)
MARSFSLLMVVLVLSYKSICSLGCNLSQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 1530 - protein, 189 aa, artificial sequence
  IFN-alpha 7 (31,102,138)
MARSFSLLMVVLVLSYKSICSLGCNLSQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1531 - protein, 189 aa, artificial sequence
  IFN-alpha 7 (31,108,138)
MARSFSLLMVVLVLSYKSICSLGCNLSQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1532 - protein, 189 aa, artificial sequence
  IFN-alpha 7 (102,108,138)
MARSFSLLMVVLVLSYKSICSLGCDLPQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1533 - protein, 189 aa, artificial sequence
  IFN-alpha 7 (31,102,108,138)
MARSFSLLMVVLVLSYKSICSLGCNLSQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVTETPLMNEDFILAVRKYFQRITLYLMEKKYSPCAWEVVRAEIMRSFSFSTNLKKGLRRKD

SEQ ID NO: 1534 - protein, 189 aa, H. sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1535 - protein, 189 aa, artificial sequence
  IFN-alpha 8 (31)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1536 - protein, 189 aa, artificial sequence
  IFN-alpha 8 (102)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKNSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1537 - protein, 189 aa, artificial sequence
  IFN-alpha 8 (108)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALNETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1538 - protein, 189 aa, artificial sequence
  IFN-alpha 8 (138)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1539 - protein, 189 aa, artificial sequence
  IFN-alpha 8 (31,102)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKNSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1540 - protein, 189 aa, artificial sequence
  IFN-alpha 8 (31,108)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKDSSAALNETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1541 - protein, 189 aa, artificial sequence
  IFN-alpha 8 (31,138)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1542 - protein, 189 aa, artificial sequence
  IFN-alpha 8 (102,108)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKNSSAALNETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1543 - protein, 189 aa, artificial sequence
  IFN-alpha 8 (102,138)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKNSSAALDETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1544 - protein, 189 aa, artificial sequence
  IFN-alpha 8 (108,138)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALNETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1545 - protein, 189 aa, artificial sequence
  IFN-alpha 8 (31,102,108)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKNSSAALNETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1546 - protein, 189 aa, artificial sequence
  IFN-alpha 8 (31,102,138)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKNSSAALDETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1547 - protein, 189 aa, artificial sequence
  IFN-alpha 8 (31,108,138)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKDSSAALNETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1548 - protein, 189 aa, artificial sequence
  IFN-alpha 8 (102,108,138)
MALTFYLLVALVVLSYKSFSSLGCDLPQTHSLGNRRALILLAQMRRISPFSCLKDRHDFEFPQEEFDDKQFQKAQAISVLHEMIQQTFNLFSTKNSSAALNETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1549 - protein, 189 aa, artificial sequence
  IFN-alpha 8 (31,102,108,138)
MALTFYLLVALVVLSYKSFSSLGCNLSQTHSLGNRRALILLAQMRRISPFSCLKDRHDFEFPQEEFDDKQFQKAQAISVLHEMIQQTFNLFSTKNSSAALNETLLDEFYIELDQQLNDLESCVMQEVGVTESPLMYEDSILAVRKYFQRITLYLTEKKYSSCAWEVVRAEIMRSFSLSINLQKRLKSKE

SEQ ID NO: 1550 - protein, 189 aa, H. sapiens
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1551 - protein, 189 aa, artificial sequence
  IFN-alpha 10 (31)
MALSFSLLMAVLVLSYKSICSLGCNLSQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1552 - protein, 189 aa, artificial sequence
  IFN-alpha 10 (102)
MALSFSLLMAVLVLSYKSICSLGCDLPQTHSLGNRRALILLGQMGRISPFSCLKDRHDFRIPQEEFDGNQFQKAQAISVLHEMIQQTFNLFSTENSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1553 - protein, 189 aa, artificial sequence
  IFN-alpha 10 (108)
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWNQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1554 - protein, 189 aa, artificial sequence
  IFN-alpha 10 (138)
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1555 - protein, 189 aa, artificial sequence
  IFN-alpha 10 (31,102)
MALSFSLLMAVLVLSYKSICSLGCNLSQTHSLGNRRALILLGQMGRISPFSCLKDRHDFRIPQEEFDGNQFQKAQAISVLHEMIQQTFNLFSTENSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1556 - protein, 189 aa, artificial sequence
  IFN-alpha 10 (31,108)
MALSFSLLMAVLVLSYKSICSLGCNLSQTHSLGNRRALILLGQMGRISPFSCLKDRHDFRIPQEEFDGNQFQKAQAISVLHEMIQQTFNLFSTEDSSAAWNQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1557 - protein, 189 aa, artificial sequence
  IFN-alpha 10 (31,138)
MALSFSLLMAVLVLSYKSICSLGCNLSQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1558 - protein, 189 aa, artificial sequence
  IFN-alpha 10 (102,108)
MALSFSLLMAVLVLSYKSICSLGCDLPQTHSLGNRRALILLGQMGRISPFSCLKDRHDFRIPQEEFDGNQFQKAQAISVLHEMIQQTFNLFSTENSSAAWNQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1559 - protein, 189 aa, artificial sequence
  IFN-alpha 10 (102,138)
MALSFSLLMAVLVLSYKSICSLGCDLPQTHSLGNRRALILLGQMGRISPFSCLKDRHDFRIPQEEFDGNQFQKAQAISVLHEMIQQTFNLFSTENSSAAWEQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1560 - protein, 189 aa, artificial sequence
  IFN-alpha 10 (108,138)
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWNQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1561 - protein, 189 aa, artificial sequence
  IFN-alpha 10 (31,102,108)
MALSFSLLMAVLVLSYKSICSLGCNLSQTHSLGNRRALILLGQMGRISPFSCLKDRHDFRIPQEEFDGNQFQKAQAISVLHEMIQQTFNLFSTENSSAAWNQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 1562 - protein, 189 aa, artificial sequence
  IFN-alpha 10 (31,102,138)
MALSFSLLMAVLVLSYKSICSLGCNLSQTHSLGNRRALILLGQMGRISPFSCLKDRHDFRIPQEEFDGNQFQKAQAISVLHEMIQQTFNLFSTENSSAAWEQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1563 - protein, 189 aa, artificial sequence
  IFN-alpha 10 (31,108,138)
MALSFSLLMAVLVLSYKSICSLGCNLSQTHSLGNRRALILLGQMGRISPFSCLKDRHDFRIPQEEFDGNQFQKAQAISVLHEMIQQTFNLFSTEDSSAAWNQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1564 - protein, 189 aa, artificial sequence
  IFN-alpha 10 (102,108,138)
MALSFSLLMAVLVLSYKSICSLGCDLPQTHSLGNRRALILLGQMGRISPFSCLKDRHDFRIPQEEFDGNQFQKAQAISVLHEMIQQTFNLFSTENSSAAWNQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1565 - protein, 189 aa, artificial sequence
  IFN-alpha 10 (31,102,108,138)
MALSFSLLMAVLVLSYKSICSLGCNLSQTHSLGNRRALILLGQMGRISPFSCLKDRHDFRIPQEEFDGNQFQKAQAISVLHEMIQQTFNLFSTENSSAAWNQSLLEKFSTELYQQLNDLEACVIQEVGVTETPLMNEDSILAVRKYFQRITLYLIERKYSPCAWEVVRAEIMRSLSFSTNLQKRLRRKD

SEQ ID NO: 1566 - protein, 189 aa, H. sapiens
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1567 - protein, 189 aa, artificial sequence
  IFN-alpha 13 (31)
MASPFALLMALVVLSCKSSCSLGCNLSETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1568 - protein, 189 aa, artificial sequence
  IFN-alpha 13 (102)
MASPFALLMALVVLSCKSSCSLGCDLPETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1569 - protein, 189 aa, artificial sequence
  IFN-alpha 13 (108)
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1570 - protein, 189 aa, artificial sequence
  IFN-alpha 13 (138)
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1571 - protein, 189 aa, artificial sequence
  IFN-alpha 13 (31,102)
MASPFALLMALVVLSCKSSCSLGCNLSETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1572 - protein, 189 aa, artificial sequence
  IFN-alpha 13 (31,108)
MASPFALLMALVVLSCKSSCSLGCNLSETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1573 - protein, 189 aa, artificial sequence
  IFN-alpha 13 (31,138)
MASPFALLMALVVLSCKSSCSLGCNLSETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1574 - protein, 189 aa, artificial sequence
  IFN-alpha 13 (102,108)
MASPFALLMALVVLSCKSSCSLGCDLPETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1575 - protein, 189 aa, artificial sequence
  IFN-alpha 13 (102,138)
MASPFALLMALVVLSCKSSCSLGCDLPETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1576 - protein, 189 aa, artificial sequence
  IFN-alpha 13 (108,138)
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1577 - protein, 189 aa, artificial sequence
  IFN-alpha 13 (31,102,108)
MASPFALLMALVVLSCKSSCSLGCNLSETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVGETPLMNADSILAVKKYFRRITLYLTEKKYSPCAWEVVRAEIMRSLSLSTNLQERLRRKE

SEQ ID NO: 1578 - protein, 189 aa, artificial sequence
  IFN-alpha 13 (31,102,138)
MASPFALLMALVVLSCKSSCSLGCNLSETHSLDNRRTLMLLAQMSRISPSSCLMDRHDFGFPQEEFDGNQFQKAPAISVLHELIQQIFNLFTTKNSSAAWDEDLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1579 - protein, 189 aa, artificial sequence
  IFN-alpha 13 (31,108,138)
MASPFALLMALVVLSCKSSCSLGCNLSETHSLDNRRTLMLLAQMSRISPSSCLMDRHDFGFPQEEFDGNQFQKAPAISVLHELIQQIFNLFTTKDSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1580 - protein, 189 aa, artificial sequence
  IFN-alpha 13 (102,108,138)
MASPFALLMALVVLSCKSSCSLGCDLPETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1581 - protein, 189 aa, artificial sequence
  IFN-alpha 13 (31,102,108,138)
MASPFALLMALVVLSCKSSCSLGCNLSETHSLDNRRTLMLLAQMSRISPSSCLMDRHDFGFPQEEFDGNQFQKAPAISVLHELIQQIFNLFTTKNSSAAWNETLLDKFCTELYQQLNDLEACVMQEERVTETPLMNADSILAVKKYFRRITLYLTEKKYSPCAWEVVRAEIMRSLSLSTNLQERLRRKE

SEQ ID NO: 1582 - protein, 189 aa, H. sapiens; identical to SEQ ID NO: 1358

SEQ ID NO: 1583-1584 - skipped (2 entries)

SEQ ID NO: 1585 - protein, 189 aa, artificial sequence
  IFN-alpha 14 (108)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWNETLLEKFYIELFQQMNDLEACVIQEVGVEETPLMNEDSILAVKKYFQRITLYLMEKKYSPCAWEVVRAEIMRSFSFSTNLQKRLRRKD

SEQ ID NO: 1586 - protein, 189 aa, artificial sequence
  IFN-alpha 14 (138)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVTETPLMNEDSILAVKKYFQRITLYLMEKKYSPCAWEVVRAEIMRSFSFSTNLQKRLRRKD

SEQ ID NO: 1587-1591 - skipped (5 entries)

SEQ ID NO: 1592 - protein, 189 aa, artificial sequence
  IFN-alpha 14 (108,138)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWNETLLEKFYIELFQQMNDLEACVIQEVGVTETPLMNEDSILAVKKYFQRITLYLMEKKYSPCAWEVVRAEIMRSFSFSTNLQKRLRRKD

SEQ ID NO: 1593-1597 - skipped (5 entries)

SEQ ID NO: 1598 - protein, 189 aa, H. sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1599 - protein, 189 aa, artificial sequence
  IFN-alpha 16 (31)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1600 - protein, 189 aa, artificial sequence
  IFN-alpha 16 (102)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKNSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1601 - protein, 189 aa, artificial sequence
  IFN-alpha 16 (108)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWNETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1602 - protein, 189 aa, artificial sequence
  IFN-alpha 16 (138)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1603 - protein, 189 aa, artificial sequence
  IFN-alpha 16 (31,102)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKNSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1604 - protein, 189 aa, artificial sequence
  IFN-alpha 16 (31,108)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKDSSAAWNETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1605 - protein, 189 aa, artificial sequence
  IFN-alpha 16 (31,138)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1606 - protein, 189 aa, artificial sequence
  IFN-alpha 16 (102,108)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKNSSAAWNETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1607 - protein, 189 aa, artificial sequence
  IFN-alpha 16 (102,138)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKNSSAAWDETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1608 - protein, 189 aa, artificial sequence
  IFN-alpha 16 (108,138)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWNETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1609 - protein, 189 aa, artificial sequence
  IFN-alpha 16 (31,102,108)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKNSSAAWNETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 1610 - protein, 189 aa, artificial sequence
  IFN-alpha 16 (31,102,138)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKNSSAAWDETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1611 - protein, 189 aa, artificial sequence
  IFN-alpha 16 (31,108,138)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKDSSAAWNETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1612 - protein, 189 aa, artificial sequence
  IFN-alpha 16 (102,108,138)
MALSFSLLMAVLVLSYKSICSLGCDLPQTHSLGNRRALILLAQMGRISHFSCLKDRYDFGFPQEVFDGNQFQKAQAISAFHEMIQQTFNLFSTKNSSAAWNETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1613 - protein, 189 aa, artificial sequence
  IFN-alpha 16 (31,102,108,138)
MALSFSLLMAVLVLSYKSICSLGCNLSQTHSLGNRRALILLAQMGRISHFSCLKDRYDFGFPQEVFDGNQFQKAQAISAFHEMIQQTFNLFSTKNSSAAWNETLLDKFYIELFQQLNDLEACVTQEVGVTEIALMNEDSILAVRKYFQRITLYLMGKKYSPCAWEVVRAEIMRSFSFSTNLQKGLRRKD

SEQ ID NO: 1614 - protein, 189 aa, H. sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1615 - protein, 189 aa, artificial sequence
  IFN-alpha 17 (31)
MALSFSLLMAVLVLSYKSICSLGCNLSQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1616 - protein, 189 aa, artificial sequence
  IFN-alpha 17 (102)
MALSFSLLMAVLVLSYKSICSLGCDLPQTHSLGNRRALILLAQMGRISPFSCLKDRHDFGLPQEEFDGNQFQKTQAISVLHEMIQQTFNLFSTENSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1617 - protein, 189 aa, artificial sequence
  IFN-alpha 17 (108)
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1618 - protein, 189 aa, artificial sequence
  IFN-alpha 17 (138)
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1619 - protein, 189 aa, artificial sequence
  IFN-alpha 17 (31,102)
MALSFSLLMAVLVLSYKSICSLGCNLSQTHSLGNRRALILLAQMGRISPFSCLKDRHDFGLPQEEFDGNQFQKTQAISVLHEMIQQTFNLFSTENSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1620 - protein, 189 aa, artificial sequence
  IFN-alpha 17 (31,108)
MALSFSLLMAVLVLSYKSICSLGCNLSQTHSLGNRRALILLAQMGRISPFSCLKDRHDFGLPQEEFDGNQFQKTQAISVLHEMIQQTFNLFSTEDSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1621 - protein, 189 aa, artificial sequence
  IFN-alpha 17 (31,138)
MALSFSLLMAVLVLSYKSICSLGCNLSQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1622 - protein, 189 aa, artificial sequence
  IFN-alpha 17 (102,108)
MALSFSLLMAVLVLSYKSICSLGCDLPQTHSLGNRRALILLAQMGRISPFSCLKDRHDFGLPQEEFDGNQFQKTQAISVLHEMIQQTFNLFSTENSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1623 - protein, 189 aa, artificial sequence
  IFN-alpha 17 (102,138)
MALSFSLLMAVLVLSYKSICSLGCDLPQTHSLGNRRALILLAQMGRISPFSCLKDRHDFGLPQEEFDGNQFQKTQAISVLHEMIQQTFNLFSTENSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1624 - protein, 189 aa, artificial sequence
  IFN-alpha 17 (108,138)
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1625 - protein, 189 aa, artificial sequence
  IFN-alpha 17 (31,102,108)
MALSFSLLMAVLVLSYKSICSLGCNLSQTHSLGNRRALILLAQMGRISPFSCLKDRHDFGLPQEEFDGNQFQKTQAISVLHEMIQQTFNLFSTENSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1626 - protein, 189 aa, artificial sequence
  IFN-alpha 17 (31,102,138)
MALSFSLLMAVLVLSYKSICSLGCNLSQTHSLGNRRALILLAQMGRISPFSCLKDRHDFGLPQEEFDGNQFQKTQAISVLHEMIQQTFNLFSTENSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1627 - protein, 189 aa, artificial sequence
  IFN-alpha 17 (31,108,138)
MALSFSLLMAVLVLSYKSICSLGCNLSQTHSLGNRRALILLAQMGRISPFSCLKDRHDFGLPQEEFDGNQFQKTQAISVLHEMIQQTFNLFSTEDSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1628 - protein, 189 aa, artificial sequence
  IFN-alpha 17 (102,108,138)
MALSFSLLMAVLVLSYKSICSLGCDLPQTHSLGNRRALILLAQMGRISPFSCLKDRHDFGLPQEEFDGNQFQKTQAISVLHEMIQQTFNLFSTENSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1629 - protein, 189 aa, artificial sequence
  IFN-alpha 17 (31,102,108,138)
MALSFSLLMAVLVLSYKSICSLGCNLSQTHSLGNRRALILLAQMGRISPFSCLKDRHDFGLPQEEFDGNQFQKTQAISVLHEMIQQTFNLFSTENSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1630 - protein, 189 aa, H. sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1631 - protein, 189 aa, artificial sequence
  IFN-alpha 21 (31)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1632 - protein, 189 aa, artificial sequence
  IFN-alpha 21 (102)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKNSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1633 - protein, 189 aa, artificial sequence
  IFN-alpha 21 (108)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWNQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1634 - protein, 189 aa, artificial sequence
  IFN-alpha 21 (138)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1635 - protein, 189 aa, artificial sequence
  IFN-alpha 21 (31,102)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKNSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1636 - protein, 189 aa, artificial sequence
  IFN-alpha 21 (31,108)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKDSSATWNQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1637 - protein, 189 aa, artificial sequence
  IFN-alpha 21 (31,138)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1638 - protein, 189 aa, artificial sequence
  IFN-alpha 21 (102,108)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKNSSATWNQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1639 - protein, 189 aa, artificial sequence
  IFN-alpha 21 (102,138)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKNSSATWEQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1640 - protein, 189 aa, artificial sequence
  IFN-alpha 21 (108,138)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWNQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1641 - protein, 189 aa, artificial sequence
  IFN-alpha 21 (31,102,108)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKNSSATWNQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 1642 - protein, 189 aa, artificial sequence
  IFN-alpha 21 (31,102,138)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKNSSATWEQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1643 - protein, 189 aa, artificial sequence
  IFN-alpha 21 (31,108,138)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKDSSATWNQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1644 - protein, 189 aa, artificial sequence
  IFN-alpha 21 (102,108,138)
MALSFSLLMAVLVLSYKSICSLGCDLPQTHSLGNRRALILLAQMGRISPFSCLKDRHDFGFPQEEFDGNQFQKAQAISVLHEMIQQTFNLFSTKNSSATWNQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1645 - protein, 189 aa, artificial sequence
  IFN-alpha 21 (31,102,108,138)
MALSFSLLMAVLVLSYKSICSLGCNLSQTHSLGNRRALILLAQMGRISPFSCLKDRHDFGFPQEEFDGNQFQKAQAISVLHEMIQQTFNLFSTKNSSATWNQSLLEKFSTELNQQLNDLEACVIQEVGVTETPLMNVDSILAVKKYFQRITLYLTEKKYSPCAWEVVRAEIMRSFSLSKIFQERLRRKE

SEQ ID NO: 1646 - protein, 189 aa, H. sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 1647-1648 - skipped (2 entries)

SEQ ID NO: 1649 - protein, 189 aa, artificial sequence
  IFN-alpha H (108)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWNETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 1650 - protein, 189 aa, artificial sequence
  IFN-alpha H (138)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVTETPLMNEDSILAVKKYFQRITLYLMEKKYSPCAWEVVRAEIMRSLSFSTNLQKRLRRKD

SEQ ID NO: 1651-1655 - skipped (5 entries)

SEQ ID NO: 1656 - protein, 189 aa, artificial sequence
  IFN-alpha H (108,138)
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWNETLLEKFYIELFQQMNDLEACVIQEVGVTETPLMNEDSILAVKKYFQRITLYLMEKKYSPCAWEVVRAEIMRSLSFSTNLQKRLRRKD

SEQ ID NO: 1657-1661 - skipped (5 entries)

SEQ ID NO: 1662 - protein, 189 aa, H. sapiens [sequence omitted]

SEQ ID NO: 1663 - protein, 189 aa, artificial sequence
  IFN-alpha I (31)
MALSFSLLMAVLVLSYKSICSLGCNLSQTHSLGNRRALILLAQMGRISPFSCLKDRPDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1664 - protein, 189 aa, artificial sequence
  IFN-alpha I (102)
MALSFSLLMAVLVLSYKSICSLGCDLPQTHSLGNRRALILLAQMGRISPFSCLKDRPDFGLPQEEFDGNQFQKTQAISVLHEMIQQTFNLFSTENSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1665 - protein, 189 aa, artificial sequence
  IFN-alpha I (108)
MALSFSLLMAVLVLSYKSICSLGCDLPQTHSLGNRRALILLAQMGRISPFSCLKDRPDFGLPQEEFDGNQFQKTQAISVLHEMIQQTFNLFSTEDSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1666 - protein, 189 aa, artificial sequence
  IFN-alpha I (138)
MALSFSLLMAVLVLSYKSICSLGCDLPQTHSLGNRRALILLAQMGRISPFSCLKDRPDFGLPQEEFDGNQFQKTQAISVLHEMIQQTFNLFSTEDSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1667 - protein, 189 aa, artificial sequence
  IFN-alpha I (31,102)
MALSFSLLMAVLVLSYKSICSLGCNLSQTHSLGNRRALILLAQMGRISPFSCLKDRPDFGLPQEEFDGNQFQKTQAISVLHEMIQQTFNLFSTENSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1668 - protein, 189 aa, artificial sequence
  IFN-alpha I (31,108)
MALSFSLLMAVLVLSYKSICSLGCNLSQTHSLGNRRALILLAQMGRISPFSCLKDRPDFGLPQEEFDGNQFQKTQAISVLHEMIQQTFNLFSTEDSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1669 - protein, 189 aa, artificial sequence
  IFN-alpha I (31,138)
MALSFSLLMAVLVLSYKSICSLGCNLSQTHSLGNRRALILLAQMGRISPFSCLKDRPDFGLPQEEFDGNQFQKTQAISVLHEMIQQTFNLFSTEDSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1670 - protein, 189 aa, artificial sequence
  IFN-alpha I (102,108)
MALSFSLLMAVLVLSYKSICSLGCDLPQTHSLGNRRALILLAQMGRISPFSCLKDRPDFGLPQEEFDGNQFQKTQAISVLHEMIQQTFNLFSTENSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1671 - protein, 189 aa, artificial sequence
  IFN-alpha I (102,138)
MALSFSLLMAVLVLSYKSICSLGCDLPQTHSLGNRRALILLAQMGRISPFSCLKDRPDFGLPQEEFDGNQFQKTQAISVLHEMIQQTFNLFSTENSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1672 - protein, 189 aa, artificial sequence
  IFN-alpha I (108,138)
MALSFSLLMAVLVLSYKSICSLGCDLPQTHSLGNRRALILLAQMGRISPFSCLKDRPDFGLPQEEFDGNQFQKTQAISVLHEMIQQTFNLFSTEDSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1673 - protein, 189 aa, artificial sequence
  IFN-alpha I (31,102,108)
MALSFSLLMAVLVLSYKSICSLGCNLSQTHSLGNRRALILLAQMGRISPFSCLKDRPDFGLPQEEFDGNQFQKTQAISVLHEMIQQTFNLFSTENSSAAWNQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 1674 - protein, 189 aa, artificial sequence
  IFN-alpha I (31,102,138)
MALSFSLLMAVLVLSYKSICSLGCNLSQTHSLGNRRALILLAQMGRISPFSCLKDRPDFGLPQEEFDGNQFQKTQAISVLHEMIQQTFNLFSTENSSAAWEQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1675 - protein, 189 aa, artificial sequence
  IFN-alpha I (31,108,138)
MALSFSLLMAVLVLSYKSICSLGCNLSQTHSLGNRRALILLAQMGRISPFSCLKDRPDFGLPQEEFDGNQFQKTQAISVLHEMIQQTFNLFSTEDSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1676 - protein, 189 aa, artificial sequence
  IFN-alpha I (102,108,138)
MALSFSLLMAVLVLSYKSICSLGCDLPQTHSLGNRRALILLAQMGRISPFSCLKDRPDFGLPQEEFDGNQFQKTQAISVLHEMIQQTFNLFSTENSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1677 - protein, 189 aa, artificial sequence
  IFN-alpha I (31,102,108,138)
MALSFSLLMAVLVLSYKSICSLGCNLSQTHSLGNRRALILLAQMGRISPFSCLKDRPDFGLPQEEFDGNQFQKTQAISVLHEMIQQTFNLFSTENSSAAWNQSLLEKFSTELYQQLNNLEACVIQEVGMTETPLMNEDSILAVRKYFQRITLYLTEKKYSPCAWEVVRAEIMRSLSFSTNLQKILRRKD

SEQ ID NO: 1678 - protein, 189 aa, H. sapiens
MARSFSLLMAVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1679 - protein, 189 aa, artificial sequence
  IFN-alpha J1 (31)
MARSFSLLMAVLVLSYKSICSLGCNLSQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1680 - protein, 189 aa, artificial sequence
  IFN-alpha J1 (102)
MARSFSLLMAVLVLSYKSICSLGCDLPQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1681 - protein, 189 aa, artificial sequence
  IFN-alpha J1 (108)
MARSFSLLMAVLVLSYKSICSLGCDLPQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1682 - protein, 189 aa, artificial sequence
  IFN-alpha J1 (138)
MARSFSLLMAVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1683 - protein, 189 aa, artificial sequence
  IFN-alpha J1 (31,102)
MARSFSLLMAVLVLSYKSICSLGCNLSQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1684 - protein, 189 aa, artificial sequence
  IFN-alpha J1 (31,108)
MARSFSLLMAVLVLSYKSICSLGCNLSQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1685 - protein, 189 aa, artificial sequence
  IFN-alpha J1 (31,138)
MARSFSLLMAVLVLSYKSICSLGCNLSQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1686 - protein, 189 aa, artificial sequence
  IFN-alpha J1 (102,108)
MARSFSLLMAVLVLSYKSICSLGCDLPQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1687 - protein, 189 aa, artificial sequence
  IFN-alpha J1 (102,138)
MARSFSLLMAVLVLSYKSICSLGCDLPQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1688 - protein, 189 aa, artificial sequence
  IFN-alpha J1 (108,138)
MARSFSLLMAVLVLSYKSICSLGCDLPQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1689 - protein, 189 aa, artificial sequence
  IFN-alpha J1 (31,102,108)
MARSFSLLMAVLVLSYKSICSLGCNLSQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVEETPLMNEDFILAVRKYFQRITLYLTEKKYSPCAWEVVRAEIMRSFSFSTNLKKGLRRKD

SEQ ID NO: 1690 - protein, 189 aa, artificial sequence
  IFN-alpha J1 (31,102,138)
MARSFSLLMAVLVLSYKSICSLGCNLSQTHSLRNRRALILLAQMGRISPFSCLKDRHEFRFPEEEFDGHQFQKTQAISVLHEMIQQTFNLFSTENSSAAWEQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1691 - protein, 189 aa, artificial sequence
  IFN-alpha J1 (31,108,138)
MARSFSLLMAVLVLSYKSICSLGCNLSQTHSLRNRRALILLAQMGRISPFSCLKDRHEFRFPEEEFDGHQFQKTQAISVLHEMIQQTFNLFSTEDSSAAWNQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1692 - protein, 189 aa, artificial sequence
  IFN-alpha J1 (102,108,138)
MARSFSLLMAVLVLSYKSICSLGCDLPQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1693 - protein, 189 aa, artificial sequence
  IFN-alpha J1 (31,102,108,138)
MARSFSLLMAVLVLSYKSICSLGCNLSQTHSLRNRRALILLAQMGRISPFSCLKDRHEFRFPEEEFDGHQFQKTQAISVLHEMIQQTFNLFSTENSSAAWNQSLLEKFSTELYQQLNDLEACVIQEVGVTETPLMNEDFILAVRKYFQRITLYLTEKKYSPCAWEVVRAEIMRSFSFSTNLKKGLRRKD

SEQ ID NO: 1694 - protein, 187 aa, H. sapiens; identical to SEQ ID NO: 1359

SEQ ID NO: 1695 - protein, 187 aa, artificial sequence
  IFN-beta 1 (31)
MTNKCLLQIALLLCFSTTALSMSYNLSGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1696 - protein, 187 aa, artificial sequence
  IFN-beta 1 (102)
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDNSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1697 - skipped

SEQ ID NO: 1698 - protein, 187 aa, artificial sequence
  IFN-beta 1 (138)
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKTDFTRGKLMSSLHLKRYYGRILHYLKAKEYSHCAWTIVRVEILRNFYFINRLTGYLRN

SEQ ID NO: 1699 - protein, 187 aa, artificial sequence
  IFN-beta 1 (31,102)
MTNKCLLQIALLLCFSTTALSMSYNLSGFLQRSSNFQCQKLLWQLNGRLEYCLKDRMNFDIPEEIKQLQQFQKEDAALTIYEMLQNIFAIFRQDNSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 1700 - skipped

SEQ ID NO: 1701 - protein, 187 aa, artificial sequence
  IFN-beta 1 (31,138)
MTNKCLLQIALLLCFSTTALSMSYNLSGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKTDFTRGKLMSSLHLKRYYGRILHYLKAKEYSHCAWTIVRVEILRNFYFINRLTGYLRN

SEQ ID NO: 1702 - skipped

SEQ ID NO: 1703 - protein, 187 aa, artificial sequence
  IFN-beta 1 (102,138)
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDNSSTGWNETIVENLLANVYHQINHLKTVLEEKLEKTDFTRGKLMSSLHLKRYYGRILHYLKAKEYSHCAWTIVRVEILRNFYFINRLTGYLRN

SEQ ID NO: 1704-1705 - skipped (2 entries)

SEQ ID NO: 1706 - protein, 187 aa, artificial sequence
  IFN-beta 1 (31,102,138)
MTNKCLLQIALLLCFSTTALSMSYNLSGFLQRSSNFQCQKLLWQLNGRLEYCLKDRMNFDIPEEIKQLQQFQKEDAALTIYEMLQNIFAIFRQDNSSTGWNETIVENLLANVYHQINHLKTVLEEKLEKTDFTRGKLMSSLHLKRYYGRILHYLKAKEYSHCAWTIVRVEILRNFYFINRLTGYLRN

SEQ ID NO: 1707-1709 - skipped (3 entries)

SEQ ID NO: 1710 - protein, 207 aa, H. sapiens
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1711 - protein, 207 aa, artificial sequence
  IFN-kappa (31)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1712 - protein, 207 aa, artificial sequence
  IFN-kappa (102)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHNFSYWKERHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1713 - protein, 207 aa, artificial sequence
  IFN-kappa (108)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWNETHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1714 - protein, 207 aa, artificial sequence
  IFN-kappa (138)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1715 - protein, 207 aa, artificial sequence
  IFN-kappa (31,102)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHNFSYWKERHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1716 - protein, 207 aa, artificial sequence
  IFN-kappa (31,108)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHTFKYWNETHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1717 - protein, 207 aa, artificial sequence
  IFN-kappa (31,138)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1718 - protein, 207 aa, artificial sequence
  IFN-kappa (102,108)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHNFSYWNETHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1719 - protein, 207 aa, artificial sequence
  IFN-kappa (102,138)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHNFSYWKERHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1720 - protein, 207 aa, artificial sequence
  IFN-kappa (108,138)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWNETHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1721 - protein, 207 aa, artificial sequence
  IFN-kappa (31,102,108)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHNFSYWNETHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 1722 - protein, 207 aa, artificial sequence
  IFN-kappa (31,102,138)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHNFSYWKERHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1723 - protein, 207 aa, artificial sequence
  IFN-kappa (31,108,138)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHTFKYWNETHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1724 - protein, 207 aa, artificial sequence
  IFN-kappa (102,108,138)
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHNFSYWNETHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1725 - protein, 207 aa, artificial sequence
  IFN-kappa (31,102,108,138)
MSTKPDMIQKCLWLEILMGIFIAGTLSLDCNLSNVHLRRVTWQNLRHLSSMSNSFPVECLRENIAFELPQEFLQYTQPMKRDIKKAFYEMSLQAFNIFSQHNFSYWNETHLKQIQIGLDQQAEYLNQCLEEDENENEDMKEMKENEMKTSEARVPQLSSLELRRYFHRIDNFLKEKKYSDCAWEIVRVEIRRCLYYFYKFTALFRRK

SEQ ID NO: 1726 - protein, 195 aa, H. sapiens; identical to SEQ ID NO: 1360

SEQ ID NO: 1727 - protein, 195 aa, artificial sequence
  IFN-omega 1 (31)
MALLFPLLAALVMTSYSPVGSLGCNLSQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 1728 - protein, 195 aa, artificial sequence
  IFN-omega 1 (102)
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTENSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 1729 - skipped

SEQ ID NO: 1730 - protein, 195 aa, artificial sequence
  IFN-omega 1 (138)
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGETESAGAISSPALTLRRYFQGIRVYLKEKKYSDCAWEVVRMEIMKSLFLSTNMQERLRSKDRDLGSS

SEQ ID NO: 1731 - protein, 195 aa, artificial sequence
  IFN-omega 1 (31,102)
MALLFPLLAALVMTSYSPVGSLGCNLSQNHGLLSRNTLVLLHQMRRISPFLCLKDRRDFRFPQEMVKGSQLQKAHVMSVLHEMLQQIFSLFHTENSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 1732 - skipped

SEQ ID NO: 1733 - protein, 195 aa, artificial sequence
  IFN-omega 1 (31,138)
MALLFPLLAALVMTSYSPVGSLGCNLSQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGETESAGAISSPALTLRRYFQGIRVYLKEKKYSDCAWEVVRMEIMKSLFLSTNMQERLRSKDRDLGSS

SEQ ID NO: 1734 - skipped

SEQ ID NO: 1735 - protein, 195 aa, artificial sequence
  IFN-omega 1 (102,138)
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTENSSAAWNMTLLDQLHTGLHQQLQHLETCLLQVVGETESAGAISSPALTLRRYFQGIRVYLKEKKYSDCAWEVVRMEIMKSLFLSTNMQERLRSKDRDLGSS

SEQ ID NO: 1736-1737 - skipped (2 entries)

SEQ ID NO: 1738 - protein, 195 aa, artificial sequence
  IFN-omega 1 (31,102,138)
MALLFPLLAALVMTSYSPVGSLGCNLSQNHGLLSRNTLVLLHQMRRISPFLCLKDRRDFRFPQEMVKGSQLQKAHVMSVLHEMLQQIFSLFHTENSSAAWNMTLLDQLHTGLHQQLQHLETCLLQVVGETESAGAISSPALTLRRYFQGIRVYLKEKKYSDCAWEVVRMEIMKSLFLSTNMQERLRSKDRDLGSS

SEQ ID NO: 1739-1741 - skipped (3 entries)

SEQ ID NO: 1742 - protein, 208 aa, H. sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1743 - protein, 208 aa, artificial sequence
  IFN-tau (31)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1744 - protein, 208 aa, artificial sequence
  IFN-tau (102)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANNSSDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1745 - protein, 208 aa, artificial sequence
  IFN-tau (108)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWNETHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1746 - protein, 208 aa, artificial sequence
  IFN-tau (138)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1747 - protein, 208 aa, artificial sequence
  IFN-tau (31,102)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANNSSDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1748 - protein, 208 aa, artificial sequence
  IFN-tau (31,108)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANISLDGWNETHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1749 - protein, 208 aa, artificial sequence
  IFN-tau (31,138)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1750 - protein, 208 aa, artificial sequence
  IFN-tau (102,108)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANNSSDGWNETHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1751 - protein, 208 aa, artificial sequence
  IFN-tau (102,138)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANNSSDGWEENHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1752 - protein, 208 aa, artificial sequence
  IFN-tau (108,138)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWNETHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1753 - protein, 208 aa, artificial sequence
  IFN-tau (31,102,108)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANNSSDGWNETHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 1754 - protein, 208 aa, artificial sequence
  IFN-tau (31,102,138)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANNSSDGWEENHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1755 - protein, 208 aa, artificial sequence
  IFN-tau (31,108,138)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANISLDGWNETHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1756 - protein, 208 aa, artificial sequence
  IFN-tau (102,108,138)
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANNSSDGWNETHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1757 - protein, 208 aa, artificial sequence
  IFN-tau (31,102,108,138)
MIIKHFFGTVLVLLASTTIFSLDLNLSIFQQRQVNQESLKLLNKLQTLSIQQCLPHRKNFLLPQKSLSPQQYQKGHTLAILHEMLQQIFSLFRANNSSDGWNETHTEKFLIQLHQQLEYLEALMGLEAEKTSGTLGSDNLRLQVKMYFRRIHDYLENQDYSTCAWAIVQVEISRCLFFVFSLTEKLSKQGRPLNDMKQELTTEFRSPR

SEQ ID NO: 1758 - protein, 189 aa, artificial sequence; identical to SEQ ID NO: 1388
  Infergen consensus interferon

SEQ ID NO: 1759 - protein, 189 aa, artificial sequence
  Infergen (31)
MALPFALMMALVVLSCKSSCSLGCNLSQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1760 - protein, 189 aa, artificial sequence
  Infergen (102)
MALPFALMMALVVLSCKSSCSLGCDLPQTHSLGNRRALILLAQMRRISPFSCLKDRHDFGFPQEEFDGNQFQKAQAISVLHEMIQQTFNLFSTKNSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1761 - protein, 189 aa, artificial sequence
  Infergen (108)
MALPFALMMALVVLSCKSSCSLGCDLPQTHSLGNRRALILLAQMRRISPFSCLKDRHDFGFPQEEFDGNQFQKAQAISVLHEMIQQTFNLFSTKDSSAAWNESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1762 - protein, 189 aa, artificial sequence
  Infergen (138)
MALPFALMMALVVLSCKSSCSLGCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1763 - protein, 189 aa, artificial sequence
  Infergen (31,102)
MALPFALMMALVVLSCKSSCSLGCNLSQTHSLGNRRALILLAQMRRISPFSCLKDRHDFGFPQEEFDGNQFQKAQAISVLHEMIQQTFNLFSTKNSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1764 - protein, 189 aa, artificial sequence
  Infergen (31,108)
MALPFALMMALVVLSCKSSCSLGCNLSQTHSLGNRRALILLAQMRRISPFSCLKDRHDFGFPQEEFDGNQFQKAQAISVLHEMIQQTFNLFSTKDSSAAWNESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1765 - protein, 189 aa, artificial sequence
  Infergen (31,138)
MALPFALMMALVVLSCKSSCSLGCNLSQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1766 - protein, 189 aa, artificial sequence
  Infergen (102,108)
MALPFALMMALVVLSCKSSCSLGCDLPQTHSLGNRRALILLAQMRRISPFSCLKDRHDFGFPQEEFDGNQFQKAQAISVLHEMIQQTFNLFSTKNSSAAWNESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1767 - protein, 189 aa, artificial sequence
  Infergen (102,138)
MALPFALMMALVVLSCKSSCSLGCDLPQTHSLGNRRALILLAQMRRISPFSCLKDRHDFGFPQEEFDGNQFQKAQAISVLHEMIQQTFNLFSTKNSSAAWDESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1768 - protein, 189 aa, artificial sequence
  Infergen (108,138)
MALPFALMMALVVLSCKSSCSLGCDLPQTHSLGNRRALILLAQMRRISPFSCLKDRHDFGFPQEEFDGNQFQKAQAISVLHEMIQQTFNLFSTKDSSAAWNESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1769 - protein, 189 aa, artificial sequence
  Infergen (31,102,108)
MALPFALMMALVVLSCKSSCSLGCNLSQTHSLGNRRALILLAQMRRISPFSCLKDRHDFGFPQEEFDGNQFQKAQAISVLHEMIQQTFNLFSTKNSSAAWNESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 1770 - protein, 189 aa, artificial sequence
  Infergen (31,102,138)
MALPFALMMALVVLSCKSSCSLGCNLSQTHSLGNRRALILLAQMRRISPFSCLKDRHDFGFPQEEFDGNQFQKAQAISVLHEMIQQTFNLFSTKNSSAAWDESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1771 - protein, 189 aa, artificial sequence
  Infergen (31,108,138)
MALPFALMMALVVLSCKSSCSLGCNLSQTHSLGNRRALILLAQMRRISPFSCLKDRHDFGFPQEEFDGNQFQKAQAISVLHEMIQQTFNLFSTKDSSAAWNESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1772 - protein, 189 aa, artificial sequence
  Infergen (102,108,138)
MALPFALMMALVVLSCKSSCSLGCDLPQTHSLGNRRALILLAQMRRISPFSCLKDRHDFGFPQEEFDGNQFQKAQAISVLHEMIQQTFNLFSTKNSSAAWNESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1773 - protein, 189 aa, artificial sequence
  Infergen (31,102,108,138)
MALPFALMMALVVLSCKSSCSLGCNLSQTHSLGNRRALILLAQMRRISPFSCLKDRHDFGFPQEEFDGNQFQKAQAISVLHEMIQQTFNLFSTKNSSAAWNESLLEKFYTELYQQLNDLEACVIQEVGVTETPLMNVDSILAVKKYFQRITLYLTEKKYSPCAWEVVRAEIMRSFSLSTNLQERLRRKE

SEQ ID NO: 1774 - protein, 168 aa, artificial sequence
  DARBEPOETIN ALFA
APPRLICDSRVLERYLLEAKEAENITTGCNETCSLNENITVPDTKVNFYAWKRMEVGQQAVEVWQGLALLSEAVLRGQALNLVNSSQVNETLQLHVDKAVSGLRSLTTLLRALGAQKEAISPPDAASAAPLRTITADTFRKLFRVYSNFLRGKLKLYTGEANCRTGDR

SEQ ID NO: 1775 - protein, 168 aa, artificial sequence
  variant erythropoietin
APPRLICDSRVLERYLLEAKEAENITTGCAEHCSLNENITVPDTKVNFYAWKRMEVGQQAVEVWQGLALLSEAVLRGQALNLVNSSQPWEPLQLHVDKAVSGLRSLTTLLRALGAQKEAISPPDAASAAPLRTITADTFRKLFRVYSNFLRGKLKLYTGEANCRTGDR

SEQ ID NO: 1776-1782 - skipped (7 entries)

SEQ ID NO: 1783 - DNA, 567 bp, H. sapiens
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1784 - DNA, 567 bp, artificial sequence
  IFN-alpha1 (31)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1785 - DNA, 567 bp, artificial sequence
  IFN-alpha1 (102)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1786 - DNA, 567 bp, artificial sequence
  IFN-alpha1 (108)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1787 - DNA, 567 bp, artificial sequence
  IFN-alpha1 (138)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1788 - DNA, 567 bp, artificial sequence
  IFN-alpha1 (31,102)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1789 - DNA, 567 bp, artificial sequence
  IFN-alpha1 (31,108)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1790 - DNA, 567 bp, artificial sequence
  IFN-alpha1 (31,138)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1791 - DNA, 567 bp, artificial sequence
  IFN-alpha1 (102,108)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1792 - DNA, 567 bp, artificial sequence
  IFN-alpha1 (102,138)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1793 - DNA, 567 bp, artificial sequence
  IFN-alpha1 (108,138)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1794 - DNA, 567 bp, artificial sequence
  IFN-alpha1 (31,102,108)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1795 - DNA, 567 bp, artificial sequence
  IFN-alpha1 (31,102,138)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1796 - DNA, 567 bp, artificial sequence
  IFN-alpha1 (31,108,138)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1797 - DNA, 567 bp, artificial sequence
  IFN-alpha1 (102,108,138)
atggcctcccccttcgccctgctgatggtgctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1798 - DNA, 567 bp, artificial sequence
  IFN-alpha1 (31,102,108,138)
atggcctcccccttcgccctgctgatggtgctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1799 - DNA, 564 bp, H. sapiens
atggccctgaccttcgccctgctggtggccctgctggtgctgtcctgcaagtcctcctgctccgtgggctgcgacctgccccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1800 - skipped

SEQ ID NO: 1801 - DNA, 564 bp, artificial sequence
  IFN-alpha 2a (31)
atggccctgaccttcgccctgctggtggccctgctggtgctgtcctgcaagtcctcctgctccgtgggctgcaacctgtcccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1802 - DNA, 564 bp, artificial sequence
  IFN-alpha 2a (102)
atggccctgaccttcgccctgctggtggccctgctggtgctgtcctgcaagtcctcctgctccgtgggctgcgacctgccccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1803 - DNA, 564 bp, artificial sequence
  IFN-alpha 2a (108)
atggccctgaccttcgccctgctggtggccctgctggtgctgtcctgcaagtcctcctgctccgtgggctgcgacctgccccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1804 - skipped

SEQ ID NO: 1805 - DNA, 564 bp, artificial sequence
  IFN-alpha 2a (31,102)
atggccctgaccttcgccctgctggtggccctgctggtgctgtcctgcaagtcctcctgctccgtgggctgcaacctgtcccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1806 - DNA, 564 bp, artificial sequence
  IFN-alpha 2a (31,108)
atggccctgaccttcgccctgctggtggccctgctggtgctgtcctgcaagtcctcctgctccgtgggctgcaacctgtcccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1807 - skipped

SEQ ID NO: 1808 - DNA, 564 bp, artificial sequence
  IFN-alpha 2a (102,108)
atggccctgaccttcgccctgctggtggccctgctggtgctgtcctgcaagtcctcctgctccgtgggctgcgacctgccccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1809-1810 - skipped (2 entries)

SEQ ID NO: 1811 - DNA, 564 bp, artificial sequence
  IFN-alpha 2a (31,102,108)
atggccctgaccttcgccctgctggtggccctgctggtgctgtcctgcaagtcctcctgctccgtgggctgcaacctgtcccagacccactccctgggctcccgccgcaccctgatgctgctggcccagatgcgcaagatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1812-1815 - skipped (4 entries)

SEQ ID NO: 1816 - DNA, 564 bp, H. sapiens
atggccctgaccttcgccctgctggtggccctgctggtgctgtcctgcaagtcctcctgctccgtgggctgcgacctgccccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1817 - DNA, 564 bp, artificial sequence
  IFN-alpha 2b (31)
atggccctgaccttcgccctgctggtggccctgctggtgctgtcctgcaagtcctcctgctccgtgggctgcaacctgtcccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1818 - DNA, 564 bp, artificial sequence
  IFN-alpha 2b (102)
atggccctgaccttcgccctgctggtggccctgctggtgctgtcctgcaagtcctcctgctccgtgggctgcgacctgccccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1819 - DNA, 564 bp, artificial sequence
  IFN-alpha 2b (108)
atggccctgaccttcgccctgctggtggccctgctggtgctgtcctgcaagtcctcctgctccgtgggctgcgacctgccccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1820 - skipped

SEQ ID NO: 1821 - DNA, 564 bp, artificial sequence
  IFN-alpha 2b (31,102)
atggccctgaccttcgccctgctggtggccctgctggtgctgtcctgcaagtcctcctgctccgtgggctgcaacctgtcccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctgggacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1822 - DNA, 564 bp, artificial sequence
  IFN-alpha 2b (31,108)
atggccctgaccttcgccctgctggtggccctgctggtgctgtcctgcaagtcctcctgctccgtgggctgcaacctgtcccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaaggactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1823 - skipped

SEQ ID NO: 1824 - DNA, 564 bp, artificial sequence
  IFN-alpha 2b (102,108)
atggccctgaccttcgccctgctggtggccctgctggtgctgtcctgcaagtcctcctgctccgtgggctgcgacctgccccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1825-1826 - skipped (2 entries)

SEQ ID NO: 1827 - DNA, 564 bp, artificial sequence
  IFN-alpha 2b (31,102,108)
atggccctgaccttcgccctgctggtggccctgctggtgctgtcctgcaagtcctcctgctccgtgggctgcaacctgtcccagacccactccctgggctcccgccgcaccctgatgctgctggcccagatgcgccgcatctccctgttctcctgcctgaaggaccgccacgacttcggcttcccccaggaggagttcggcaaccagttccagaaggccgagaccatccccgtgctgcacgagatgatccagcagatcttcaacctgttctccaccaagaactcctccgccgcctggaacgagaccctgctggacaagttctacaccgagctgtaccagcagctgaacgacctggaggcctgcgtgatccagggcgtgggcgtgaccgagacccccctgatgaaggaggactccatcctggccgtgcgcaagtacttccagcgcatcaccctgtacctgaaggagaagaagtactccccctgcgcctgggaggtggtgcgcgccgagatcatgcgctccttctccctgtccaccaacctgcaggagtccctgcgctccaaggag

SEQ ID NO: 1828-1831 - skipped (4 entries)

SEQ ID NO: 1832 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1833 - DNA, 567 bp, artificial sequence
  IFN-alpha 4a (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1834 - DNA, 567 bp, artificial sequence
  IFN-alpha 4a (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1835 - DNA, 567 bp, artificial sequence
  IFN-alpha 4a (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1836 - DNA, 567 bp, artificial sequence
  IFN-alpha 4a (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1837 - DNA, 567 bp, artificial sequence
  IFN-alpha 4a (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1838 - DNA, 567 bp, artificial sequence
  IFN-alpha 4a (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1839 - DNA, 567 bp, artificial sequence
  IFN-alpha 4a (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1840 - DNA, 567 bp, artificial sequence
  IFN-alpha 4a (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1841 - DNA, 567 bp, artificial sequence
  IFN-alpha 4a (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1842 - DNA, 567 bp, artificial sequence
  IFN-alpha 4a (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1843 - DNA, 567 bp, artificial sequence
  IFN-alpha 4a (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1844 - DNA, 567 bp, artificial sequence
  IFN-alpha 4a (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1845 - DNA, 567 bp, artificial sequence
  IFN-alpha 4a (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1846 - DNA, 567 bp, artificial sequence
  IFN-alpha 4a (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1847 - DNA, 567 bp, artificial sequence
  IFN-alpha 4a (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1848 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1849 - DNA, 567 bp, artificial sequence
  IFN-alpha 4b (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1850 - DNA, 567 bp, artificial sequence
  IFN-alpha 4b (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1851 - DNA, 567 bp, artificial sequence
  IFN-alpha 4b (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1852 - DNA, 567 bp, artificial sequence
  IFN-alpha 4b (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1853 - DNA, 567 bp, artificial sequence
  IFN-alpha 4b (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1854 - DNA, 567 bp, artificial sequence
  IFN-alpha 4b (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1855 - DNA, 567 bp, artificial sequence
  IFN-alpha 4b (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1856 - DNA, 567 bp, artificial sequence
  IFN-alpha 4b (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1857 - DNA, 567 bp, artificial sequence
  IFN-alpha 4b (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1858 - DNA, 567 bp, artificial sequence
  IFN-alpha 4b (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1859 - DNA, 567 bp, artificial sequence
  IFN-alpha 4b (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1860 - DNA, 567 bp, artificial sequence
  IFN-alpha 4b (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1861 - DNA, 567 bp, artificial sequence
  IFN-alpha 4b (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1862 - DNA, 567 bp, artificial sequence
  IFN-alpha 4b (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1863 - DNA, 567 bp, artificial sequence
  IFN-alpha 4b (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgccacgacttcggcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgtggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagcgcctgcgccgcaaggac

SEQ ID NO: 1864 - DNA, 567 bp, H. sapiens
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1865 - DNA, 567 bp, artificial sequence
  IFN-alpha 5 (31)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1866 - DNA, 567 bp, artificial sequence
  IFN-alpha 5 (102)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1867 - DNA, 567 bp, artificial sequence
  IFN-alpha 5 (108)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1868 - DNA, 567 bp, artificial sequence
  IFN-alpha 5 (138)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1869 - DNA, 567 bp, artificial sequence
  IFN-alpha 5 (31,102)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1870 - DNA, 567 bp, artificial sequence
  IFN-alpha 5 (31,108)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1871 - DNA, 567 bp, artificial sequence
  IFN-alpha 5 (31,138)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1872 - DNA, 567 bp, artificial sequence
  IFN-alpha 5 (102,108)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1873 - DNA, 567 bp, artificial sequence
  IFN-alpha 5 (102,138)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1874 - DNA, 567 bp, artificial sequence
  IFN-alpha 5 (108,138)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1875 - DNA, 567 bp, artificial sequence
  IFN-alpha 5 (31,102,108)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaacgagaccctgctggacaagttctacaccgagctgtaccagcagctgaacgacctggaggcctgcatgatgcaggaggtgggcgtggaggacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1876 - DNA, 567 bp, artificial sequence
  IFN-alpha 5 (31,102,138)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1877 - DNA, 567 bp, artificial sequence
  IFN-alpha 5 (31,108,138)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1878 - DNA, 567 bp, artificial sequence
  IFN-alpha 5 (102,108,138)
atggccctgcccttcgtgctgctgatggccctggtggtgctgaactgcaagtccatctgctccctgggctgcgacctgccccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1879 - DNA, 567 bp, artificial sequence
  IFN-alpha 5 (31,102,108,138)
atggccctgcccttcgtgctgctgatggccctggtggtgctgaactgcaagtccatctgctccctgggctgcaacctgtcccagacccactccctgtccaaccgccgcaccctgatgatcatggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaacgagaccctgctggacaagttctacaccgagctgtaccagcagctgaacgacctggaggcctgcatgatgcaggaggtgggcgtgaccgacacccccctgatgaacgtggactccatcctgaccgtgcgcaagtacttccagcgcatcaccctgtacctgaccgagaagaagtactccccctgcgcctgggaggtggtgcgcgccgagatcatgcgctccttctccctgtccgccaacctgcaggagcgcctgcgccgcaaggag

SEQ ID NO: 1880 - DNA, 567 bp, H. sapiens
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctgggacgagcgcctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1881 - DNA, 567 bp, artificial sequence
  IFN-alpha 6 (31)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctgggacgagcgcctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1882 - DNA, 567 bp, artificial sequence
  IFN-alpha 6 (102)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctgggacgagcgcctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1883 - DNA, 567 bp, artificial sequence
  IFN-alpha 6 (108)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctggaacgagaccctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1884 - DNA, 567 bp, artificial sequence
  IFN-alpha 6 (138)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctgggacgagcgcctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1885 - DNA, 567 bp, artificial sequence
  IFN-alpha 6 (31,102)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctgggacgagcgcctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1886 - DNA, 567 bp, artificial sequence
  IFN-alpha 6 (31,108)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctggaacgagaccctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1887 - DNA, 567 bp, artificial sequence
  IFN-alpha 6 (31,138)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctgggacgagcgcctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1888 - DNA, 567 bp, artificial sequence
  IFN-alpha 6 (102,108)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctggaacgagaccctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1889 - DNA, 567 bp, artificial sequence
  IFN-alpha 6 (102,138)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctgggacgagcgcctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1890 - DNA, 567 bp, artificial sequence
  IFN-alpha 6 (108,138)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctggaacgagaccctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1891 - DNA, 567 bp, artificial sequence
  IFN-alpha 6 (31,102,108)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctggaacgagaccctgctggacaagctgtacaccgagctgtaccagcagctgaacgacctggaggcctgcgtgatgcaggaggtgtgggtgggcggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1892 - DNA, 567 bp, artificial sequence
  IFN-alpha 6 (31,102,138)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctgggacgagcgcctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1893 - DNA, 567 bp, artificial sequence
  IFN-alpha 6 (31,108,138)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaaggactcctccgtggcctggaacgagaccctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1894 - DNA, 567 bp, artificial sequence
  IFN-alpha 6 (102,108,138)
atggccctgcccttcgccctgctgatggccctggtggtgctgtcctgcaagtcctcctgctccctggactgcgacctgccccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctggaacgagaccctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1895 - DNA, 567 bp, artificial sequence
  IFN-alpha 6 (31,102,108,138)
atggccctgcccttcgccctgctgatggccctggtggtgctgtcctgcaagtcctcctgctccctggactgcaacctgtcccagacccactccctgggccaccgccgcaccatgatgctgctggcccagatgcgccgcatctccctgttctcctgcctgaaggaccgccacgacttccgcttcccccaggaggagttcgacggcaaccagttccagaaggccgaggccatctccgtgctgcacgaggtgatccagcagaccttcaacctgttctccaccaagaactcctccgtggcctggaacgagaccctgctggacaagctgtacaccgagctgtaccagcagctgaacgacctggaggcctgcgtgatgcaggaggtgtgggtgaccggcacccccctgatgaacgaggactccatcctggccgtgcgcaagtacttccagcgcatcaccctgtacctgaccgagaagaagtactccccctgcgcctgggaggtggtgcgcgccgagatcatgcgctccttctcctcctcccgcaacctgcaggagcgcctgcgccgcaaggag

SEQ ID NO: 1896 - DNA, 567 bp, H. sapiens
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1897 - DNA, 567 bp, artificial sequence
  IFN-alpha 7 (31)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1898 - DNA, 567 bp, artificial sequence
  IFN-alpha 7 (102)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1899 - DNA, 567 bp, artificial sequence
  IFN-alpha 7 (108)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1900 - DNA, 567 bp, artificial sequence
  IFN-alpha 7 (138)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1901 - DNA, 567 bp, artificial sequence
  IFN-alpha 7 (31,102)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1902 - DNA, 567 bp, artificial sequence
  IFN-alpha 7 (31,108)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1903 - DNA, 567 bp, artificial sequence
  IFN-alpha 7 (31,138)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1904 - DNA, 567 bp, artificial sequence
  IFN-alpha 7 (102,108)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1905 - DNA, 567 bp, artificial sequence
  IFN-alpha 7 (102,138)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1906 - DNA, 567 bp, artificial sequence
  IFN-alpha 7 (108,138)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1907 - DNA, 567 bp, artificial sequence
  IFN-alpha 7 (31,102,108)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1908 - DNA, 567 bp, artificial sequence
  IFN-alpha 7 (31,102,138)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1909 - DNA, 567 bp, artificial sequence
  IFN-alpha 7 (31,108,138)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1910 - DNA, 567 bp, artificial sequence
  IFN-alpha 7 (102,108,138)
atggcccgctccttctccctgctgatggtggtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1911 - DNA, 567 bp, artificial sequence
  IFN-alpha 7 (31,102,108,138)
atggcccgctccttctccctgctgatggtggtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgatggagaagaagtactccccctgcgcctgggaggtggtgcgcgccgagatcatgcgctccttctccttctccaccaacctgaagaagggcctgcgccgcaaggac

SEQ ID NO: 1912 - DNA, 567 bp, H. sapiens
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctggacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1913 - DNA, 567 bp, artificial sequence
  IFN-alpha 8 (31)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctggacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1914 - DNA, 567 bp, artificial sequence
  IFN-alpha 8 (102)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctggacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1915 - DNA, 567 bp, artificial sequence
  IFN-alpha 8 (108)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctgaacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1916 - DNA, 567 bp, artificial sequence
  IFN-alpha 8 (138)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctggacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1917 - DNA, 567 bp, artificial sequence
  IFN-alpha 8 (31,102)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctggacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1918 - DNA, 567 bp, artificial sequence
  IFN-alpha 8 (31,108)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctgaacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1919 - DNA, 567 bp, artificial sequence
  IFN-alpha 8 (31,138)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctggacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1920 - DNA, 567 bp, artificial sequence
  IFN-alpha 8 (102,108)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctgaacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1921 - DNA, 567 bp, artificial sequence
  IFN-alpha 8 (102,138)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctggacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1922 - DNA, 567 bp, artificial sequence
  IFN-alpha 8 (108,138)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctgaacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1923 - DNA, 567 bp, artificial sequence
  IFN-alpha 8 (31,102,108)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctgaacgagaccctgctggacgagttctacatcgagctggaccagcagctgaacgacctggagtcctgcgtgatgcaggaggtgggcgtgatcgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1924 - DNA, 567 bp, artificial sequence
  IFN-alpha 8 (31,102,138)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctggacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1925 - DNA, 567 bp, artificial sequence
  IFN-alpha 8 (31,108,138)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaaggactcctccgccgccctgaacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1926 - DNA, 567 bp, artificial sequence
  IFN-alpha 8 (102,108,138)
atggccctgaccttctacctgctggtggccctggtggtgctgtcctacaagtccttctcctccctgggctgcgacctgccccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctgaacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1927 - DNA, 567 bp, artificial sequence
  IFN-alpha 8 (31,102,108,138)
atggccctgaccttctacctgctggtggccctggtggtgctgtcctacaagtccttctcctccctgggctgcaacctgtcccagacccactccctgggcaaccgccgcgccctgatcctgctggcccagatgcgccgcatctcccccttctcctgcctgaaggaccgccacgacttcgagttcccccaggaggagttcgacgacaagcagttccagaaggcccaggccatctccgtgctgcacgagatgatccagcagaccttcaacctgttctccaccaagaactcctccgccgccctgaacgagaccctgctggacgagttctacatcgagctggaccagcagctgaacgacctggagtcctgcgtgatgcaggaggtgggcgtgaccgagtcccccctgatgtacgaggactccatcctggccgtgcgcaagtacttccagcgcatcaccctgtacctgaccgagaagaagtactcctcctgcgcctgggaggtggtgcgcgccgagatcatgcgctccttctccctgtccatcaacctgcagaagcgcctgaagtccaaggag

SEQ ID NO: 1928 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1929 - DNA, 567 bp, artificial sequence
  IFN-alpha 10 (31)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1930 - DNA, 567 bp, artificial sequence
  IFN-alpha 10 (102)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1931 - DNA, 567 bp, artificial sequence
  IFN-alpha 10 (108)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1932 - DNA, 567 bp, artificial sequence
  IFN-alpha 10 (138)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1933 - DNA, 567 bp, artificial sequence
  IFN-alpha 10 (31,102)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1934 - DNA, 567 bp, artificial sequence
  IFN-alpha 10 (31,108)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1935 - DNA, 567 bp, artificial sequence
  IFN-alpha 10 (31,138)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1936 - DNA, 567 bp, artificial sequence
  IFN-alpha 10 (102,108)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1937 - DNA, 567 bp, artificial sequence
  IFN-alpha 10 (102,138)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1938 - DNA, 567 bp, artificial sequence
  IFN-alpha 10 (108,138)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1939 - DNA, 567 bp, artificial sequence
  IFN-alpha 10 (31,102,108)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1940 - DNA, 567 bp, artificial sequence
  IFN-alpha 10 (31,102,138)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1941 - DNA, 567 bp, artificial sequence
  IFN-alpha 10 (31,108,138)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1942 - DNA, 567 bp, artificial sequence
  IFN-alpha 10 (102,108,138)
atggccctgtccttctccctgctgatggccgtgctggtgctgtcctacaagtccatctgctccctgggctgcgacctgccccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1943 - DNA, 567 bp, artificial sequence
  IFN-alpha 10 (31,102,108,138)
atggccctgtccttctccctgctgatggccgtgctggtgctgtcctacaagtccatctgctccctgggctgcaacctgtcccagacccactccctgggcaaccgccgcgccctgatcctgctgggccagatgggccgcatctcccccttctcctgcctgaaggaccgccacgacttccgcatcccccaggaggagttcgacggcaaccagttccagaaggcccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggactccatcctggccgtgcgcaagtacttccagcgcatcaccctgtacctgatcgagcgcaagtactccccctgcgcctgggaggtggtgcgcgccgagatcatgcgctccctgtccttctccaccaacctgcagaagcgcctgcgccgcaaggac

SEQ ID NO: 1944 - DNA, 567 bp, H. sapiens
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1945 - DNA, 567 bp, artificial sequence
  IFN-alpha 13 (31)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1946 - DNA, 567 bp, artificial sequence
  IFN-alpha 13 (102)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1947 - DNA, 567 bp, artificial sequence
  IFN-alpha 13 (108)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1948 - DNA, 567 bp, artificial sequence
  IFN-alpha 13 (138)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1949 - DNA, 567 bp, artificial sequence
  IFN-alpha 13 (31,102)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1950 - DNA, 567 bp, artificial sequence
  IFN-alpha 13 (31,108)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1951 - DNA, 567 bp, artificial sequence
  IFN-alpha 13 (31,138)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1952 - DNA, 567 bp, artificial sequence
  IFN-alpha 13 (102,108)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1953 - DNA, 567 bp, artificial sequence
  IFN-alpha 13 (102,138)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1954 - DNA, 567 bp, artificial sequence
  IFN-alpha 13 (108,138)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1955 - DNA, 567 bp, artificial sequence
  IFN-alpha 13 (31,102,108)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgggcgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1956 - DNA, 567 bp, artificial sequence
  IFN-alpha 13 (31,102,138)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctgggacgaggacctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1957 - DNA, 567 bp, artificial sequence
  IFN-alpha 13 (31,108,138)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaaggactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1958 - DNA, 567 bp, artificial sequence
  IFN-alpha 13 (102,108,138)
atggcctcccccttcgccctgctgatggccctggtggtgctgtcctgcaagtcctcctgctccctgggctgcgacctgcccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1959 - DNA, 567 bp, artificial sequence
  IFN-alpha 13 (31,102,108,138)
atggcctcccccttcgccctgctgatggccctggtggtgctgtcctgcaagtcctcctgctccctgggctgcaacctgtccgagacccactccctggacaaccgccgcaccctgatgctgctggcccagatgtcccgcatctccccctcctcctgcctgatggaccgccacgacttcggcttcccccaggaggagttcgacggcaaccagttccagaaggcccccgccatctccgtgctgcacgagctgatccagcagatcttcaacctgttcaccaccaagaactcctccgccgcctggaacgagaccctgctggacaagttctgcaccgagctgtaccagcagctgaacgacctggaggcctgcgtgatgcaggaggagcgcgtgaccgagacccccctgatgaacgccgactccatcctggccgtgaagaagtacttccgccgcatcaccctgtacctgaccgagaagaagtactccccctgcgcctgggaggtggtgcgcgccgagatcatgcgctccctgtccctgtccaccaacctgcaggagcgcctgcgccgcaaggag

SEQ ID NO: 1960 - DNA, 567 bp, H. sapiens
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctgggacgagaccctgctggagaagttctacatcgagctgttccagcagatgaacgacctggaggcctgcgtgatccaggaggtgggcgtggaggagacccccctgatgaacgaggactccatcctggccgtgaagaagtacttccagcgcatcaccctgtacctgatggagaagaagtactccccctgcgcctgggaggtggtgcgcgccgagatcatgcgctccttctccttctccaccaacctgcagaagcgcctgcgccgcaaggac

SEQ ID NO: 1961-1962 - skipped (2 entries)

SEQ ID NO: 1963 - DNA, 567 bp, artificial sequence
  IFN-alpha 14 (108)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctggaacgagaccctgctggagaagttctacatcgagctgttccagcagatgaacgacctggaggcctgcgtgatccaggaggtgggcgtggaggagacccccctgatgaacgaggactccatcctggccgtgaagaagtacttccagcgcatcaccctgtacctgatggagaagaagtactccccctgcgcctgggaggtggtgcgcgccgagatcatgcgctccttctccttctccaccaacctgcagaagcgcctgcgccgcaaggac

SEQ ID NO: 1964 - DNA, 567 bp, artificial sequence
  IFN-alpha 14 (138)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctgggacgagaccctgctggagaagttctacatcgagctgttccagcagatgaacgacctggaggcctgcgtgatccaggaggtgggcgtgaccgagacccccctgatgaacgaggactccatcctggccgtgaagaagtacttccagcgcatcaccctgtacctgatggagaagaagtactccccctgcgcctgggaggtggtgcgcgccgagatcatgcgctccttctccttctccaccaacctgcagaagcgcctgcgccgcaaggac

SEQ ID NO: 1965-1969 - skipped (5 entries)

SEQ ID NO: 1970 - DNA, 567 bp, artificial sequence
  IFN-alpha 14 (108,138)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctggaacgagaccctgctggagaagttctacatcgagctgttccagcagatgaacgacctggaggcctgcgtgatccaggaggtgggcgtgaccgagacccccctgatgaacgaggactccatcctggccgtgaagaagtacttccagcgcatcaccctgtacctgatggagaagaagtactccccctgcgcctgggaggtggtgcgcgccgagatcatgcgctccttctccttctccaccaacctgcagaagcgcctgcgccgcaaggac

SEQ ID NO: 1971-1975 - skipped (5 entries)

SEQ ID NO: 1976 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctgggacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1977 - DNA, 567 bp, artificial sequence
  IFN-alpha 16 (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctgggacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1978 - DNA, 567 bp, artificial sequence
  IFN-alpha 16 (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctgggacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1979 - DNA, 567 bp, artificial sequence
  IFN-alpha 16 (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctggaacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1980 - DNA, 567 bp, artificial sequence
  IFN-alpha 16 (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctgggacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1981 - DNA, 567 bp, artificial sequence
  IFN-alpha 16 (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctgggacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1982 - DNA, 567 bp, artificial sequence
  IFN-alpha 16 (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctggaacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1983 - DNA, 567 bp, artificial sequence
  IFN-alpha 16 (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctgggacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1984 - DNA, 567 bp, artificial sequence
  IFN-alpha 16 (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctggaacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1985 - DNA, 567 bp, artificial sequence
  IFN-alpha 16 (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctgggacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1986 - DNA, 567 bp, artificial sequence
  IFN-alpha 16 (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctggaacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1987 - DNA, 567 bp, artificial sequence
  IFN-alpha 16 (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctggaacgagaccctgctggacaagttctacatcgagctgttccagcagctgaacgacctggaggcctgcgtgacccaggaggtgggcgtggaggagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1988 - DNA, 567 bp, artificial sequence
  IFN-alpha 16 (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctgggacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1989 - DNA, 567 bp, artificial sequence
  IFN-alpha 16 (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaaggactcctccgccgcctggaacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1990 - DNA, 567 bp, artificial sequence
  IFN-alpha 16 (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctggaacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1991 - DNA, 567 bp, artificial sequence
  IFN-alpha 16 (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccacttctcctgcctgaaggaccgctacgacttcggcttcccccaggaggtgttcgacggcaaccagttccagaaggcccaggccatctccgccttccacgagatgatccagcagaccttcaacctgttctccaccaagaactcctccgccgcctggaacgagaccctgctggacaagttctacatcgagctgttccagcagctgaacgacctggaggcctgcgtgacccaggaggtgggcgtgaccgagatcgccctgatgaacgaggactccatcctggccgtgcgcaagtacttccagcgcatcaccctgtacctgatgggcaagaagtactccccctgcgcctgggaggtggtgcgcgccgagatcatgcgctccttctccttctccaccaacctgcagaagggcctgcgccgcaaggac

SEQ ID NO: 1992 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1993 - DNA, 567 bp, artificial sequence
  IFN-alpha 17 (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1994 - DNA, 567 bp, artificial sequence
  IFN-alpha 17 (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1995 - DNA, 567 bp, artificial sequence
  IFN-alpha 17 (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1996 - DNA, 567 bp, artificial sequence
  IFN-alpha 17 (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1997 - DNA, 567 bp, artificial sequence
  IFN-alpha 17 (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1998 - DNA, 567 bp, artificial sequence
  IFN-alpha 17 (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 1999 - DNA, 567 bp, artificial sequence
  IFN-alpha 17 (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2000 - DNA, 567 bp, artificial sequence
  IFN-alpha 17 (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2001 - DNA, 567 bp, artificial sequence
  IFN-alpha 17 (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2002 - DNA, 567 bp, artificial sequence
  IFN-alpha 17 (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2003 - DNA, 567 bp, artificial sequence
  IFN-alpha 17 (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2004 - DNA, 567 bp, artificial sequence
  IFN-alpha 17 (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2005 - DNA, 567 bp, artificial sequence
  IFN-alpha 17 (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2006 - DNA, 567 bp, artificial sequence
  IFN-alpha 17 (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2007 - DNA, 567 bp, artificial sequence
  IFN-alpha 17 (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2008 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggagcagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2009 - DNA, 567 bp, artificial sequence
  IFN-alpha 21 (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggagcagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2010 - DNA, 567 bp, artificial sequence
  IFN-alpha 21 (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggagcagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2011 - DNA, 567 bp, artificial sequence
  IFN-alpha 21 (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaaccagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2012 - DNA, 567 bp, artificial sequence
  IFN-alpha 21 (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggagcagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2013 - DNA, 567 bp, artificial sequence
  IFN-alpha 21 (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggagcagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2014 - DNA, 567 bp, artificial sequence
  IFN-alpha 21 (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaaccagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2015 - DNA, 567 bp, artificial sequence
  IFN-alpha 21 (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctgggagcagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2016 - DNA, 567 bp, artificial sequence
  IFN-alpha 21 (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaaccagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2017 - DNA, 567 bp, artificial sequence
  IFN-alpha 21 (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggagcagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2018 - DNA, 567 bp, artificial sequence
  IFN-alpha 21 (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaaccagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2019 - DNA, 567 bp, artificial sequence
  IFN-alpha 21 (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaaccagtccctgctggagaagttctccaccgagctgaaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2020 - DNA, 567 bp, artificial sequence
  IFN-alpha 21 (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctgggagcagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2021 - DNA, 567 bp, artificial sequence
  IFN-alpha 21 (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccacctggaaccagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2022 - DNA, 567 bp, artificial sequence
  IFN-alpha 21 (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaaccagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2023 - DNA, 567 bp, artificial sequence
  IFN-alpha 21 (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccacctggaaccagtccctgctggagaagttctccaccgagctgaaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaagatcttccaggagcgcctgcgccgcaaggag

SEQ ID NO: 2024 - DNA, 567 bp, H. sapiens
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctgggacgagaccctgctggagaagttctacatcgagctgttccagcagatgaacgacctggaggcctgcgtgatccaggaggtgggcgtggaggagacccccctgatgaacgaggactccatcctggccgtgaagaagtacttccagcgcatcaccctgtacctgatggagaagaagtactccccctgcgcctgggaggtggtgcgcgccgagatcatgcgctccctgtccttctccaccaacctgcagaagcgcctgcgccgcaaggac

SEQ ID NO: 2025-2026 - skipped (2 entries)

SEQ ID NO: 2027 - DNA, 567 bp, artificial sequence
  IFN-alpha H (108)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctggaacgagaccctgctggagaagttctacatcgagctgttccagcagatgaacgacctggaggcctgcgtgatccaggaggtgggcgtggaggagacccccctgatgaacgaggactccatcctggccgtgaagaagtacttccagcgcatcaccctgtacctgatggagaagaagtactccccctgcgcctgggaggtggtgcgcgccgagatcatgcgctccctgtccttctccaccaacctgcagaagcgcctgcgccgcaaggac

SEQ ID NO: 2028 - DNA, 567 bp, artificial sequence
  IFN-alpha H (138)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctgggacgagaccctgctggagaagttctacatcgagctgttccagcagatgaacgacctggaggcctgcgtgatccaggaggtgggcgtgaccgagacccccctgatgaacgaggactccatcctggccgtgaagaagtacttccagcgcatcaccctgtacctgatggagaagaagtactccccctgcgcctgggaggtggtgcgcgccgagatcatgcgctccctgtccttctccaccaacctgcagaagcgcctgcgccgcaaggac

SEQ ID NO: 2029-2033 - skipped (5 entries)

SEQ ID NO: 2034 - DNA, 567 bp, artificial sequence
  IFN-alpha H (108,138)
atggccctgcccttcgccctgatgatggccctggtggtgctgtcctgcaagtcctcctgctccctgggctgcaacctgtcccagacccactccctgaacaaccgccgcaccctgatgctgatggcccagatgcgccgcatctcccccttctcctgcctgaaggaccgccacgacttcgagttcccccaggaggagttcgacggcaaccagttccagaaggcccaggccatctccgtgctgcacgagatgatgcagcagaccttcaacctgttctccaccaagaactcctccgccgcctggaacgagaccctgctggagaagttctacatcgagctgttccagcagatgaacgacctggaggcctgcgtgatccaggaggtgggcgtgaccgagacccccctgatgaacgaggactccatcctggccgtgaagaagtacttccagcgcatcaccctgtacctgatggagaagaagtactccccctgcgcctgggaggtggtgcgcgccgagatcatgcgctccctgtccttctccaccaacctgcagaagcgcctgcgccgcaaggac

SEQ ID NO: 2035-2039 - skipped (5 entries)

SEQ ID NO: 2040 - DNA, 567 bp, H. sapiens
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2041 - DNA, 567 bp, artificial sequence
  IFN-alpha I (31)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2042 - DNA, 567 bp, artificial sequence
  IFN-alpha I (102)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2043 - DNA, 567 bp, artificial sequence
  IFN-alpha I (108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2044 - DNA, 567 bp, artificial sequence
  IFN-alpha I (138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2045 - DNA, 567 bp, artificial sequence
  IFN-alpha I (31,102)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2046 - DNA, 567 bp, artificial sequence
  IFN-alpha I (31,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2047 - DNA, 567 bp, artificial sequence
  IFN-alpha I (31,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2048 - DNA, 567 bp, artificial sequence
  IFN-alpha I (102,108)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2049 - DNA, 567 bp, artificial sequence
  IFN-alpha I (102,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2050 - DNA, 567 bp, artificial sequence
  IFN-alpha I (108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2051 - DNA, 567 bp, artificial sequence
  IFN-alpha I (31,102,108)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatggaggagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2052 - DNA, 567 bp, artificial sequence
  IFN-alpha I (31,102,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2053 - DNA, 567 bp, artificial sequence
  IFN-alpha I (31,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2054 - DNA, 567 bp, artificial sequence
  IFN-alpha I (102,108,138)
atggccctgtccttctccctgctgatggccgtgctggtgctgtcctacaagtccatctgctccctgggctgcgacctgccccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2055 - DNA, 567 bp, artificial sequence
  IFN-alpha I (31,102,108,138)
atggccctgtccttctccctgctgatggccgtgctggtgctgtcctacaagtccatctgctccctgggctgcaacctgtcccagacccactccctgggcaaccgccgcgccctgatcctgctggcccagatgggccgcatctcccccttctcctgcctgaaggaccgccccgacttcggcctgccccaggaggagttcgacggcaaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacaacctggaggcctgcgtgatccaggaggtgggcatgaccgagacccccctgatgaacgaggactccatcctggccgtgcgcaagtacttccagcgcatcaccctgtacctgaccgagaagaagtactccccctgcgcctgggaggtggtgcgcgccgagatcatgcgctccctgtccttctccaccaacctgcagaagatcctgcgccgcaaggac

SEQ ID NO: 2056 - DNA, 567 bp, H. sapiens
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2057 - DNA, 567 bp, artificial sequence
  IFN-alpha J1 (31)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2058 - DNA, 567 bp, artificial sequence
  IFN-alpha J1 (102)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2059 - DNA, 567 bp, artificial sequence
  IFN-alpha J1 (108)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2060 - DNA, 567 bp, artificial sequence
  IFN-alpha J1 (138)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2061 - DNA, 567 bp, artificial sequence
  IFN-alpha J1 (31,102)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2062 - DNA, 567 bp, artificial sequence
  IFN-alpha J1 (31,108)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2063 - DNA, 567 bp, artificial sequence
  IFN-alpha J1 (31,138)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2064 - DNA, 567 bp, artificial sequence
  IFN-alpha J1 (102,108)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2065 - DNA, 567 bp, artificial sequence
  IFN-alpha J1 (102,138)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2066 - DNA, 567 bp, artificial sequence
  IFN-alpha J1 (108,138)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2067 - DNA, 567 bp, artificial sequence
  IFN-alpha J1 (31,102,108)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtggaggagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2068 - DNA, 567 bp, artificial sequence
  IFN-alpha J1 (31,102,138)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctgggagcagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2069 - DNA, 567 bp, artificial sequence
  IFN-alpha J1 (31,108,138)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgaggactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2070 - DNA, 567 bp, artificial sequence
  IFN-alpha J1 (102,108,138)
atggcccgctccttctccctgctgatggccgtgctggtgctgtcctacaagtccatctgctccctgggctgcgacctgccccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2071 - DNA, 567 bp, artificial sequence
  IFN-alpha J1 (31,102,108,138)
atggcccgctccttctccctgctgatggccgtgctggtgctgtcctacaagtccatctgctccctgggctgcaacctgtcccagacccactccctgcgcaaccgccgcgccctgatcctgctggcccagatgggccgcatctcccccttctcctgcctgaaggaccgccacgagttccgcttccccgaggaggagttcgacggccaccagttccagaagacccaggccatctccgtgctgcacgagatgatccagcagaccttcaacctgttctccaccgagaactcctccgccgcctggaaccagtccctgctggagaagttctccaccgagctgtaccagcagctgaacgacctggaggcctgcgtgatccaggaggtgggcgtgaccgagacccccctgatgaacgaggacttcatcctggccgtgcgcaagtacttccagcgcatcaccctgtacctgaccgagaagaagtactccccctgcgcctgggaggtggtgcgcgccgagatcatgcgctccttctccttctccaccaacctgaagaagggcctgcgccgcaaggac

SEQ ID NO: 2072 - DNA, 561 bp, H. sapiens
atgaccaacaagtgcctgctgcagatcgccctgctgctgtgcttctccaccaccgccctgtccatgtcctacaacctgctgggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggactcctcctccaccggctggaacgagaccatcgtggagaacctgctggccaacgtgtaccaccagatcaaccacctgaagaccgtgctggaggagaagctggagaaggaggacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2073 - DNA, 561 bp, artificial sequence
  IFN-beta 1 (31)
atgaccaacaagtgcctgctgcagatcgccctgctgctgtgcttctccaccaccgccctgtccatgtcctacaacctgtccggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggactcctcctccaccggctggaacgagaccatcgtggagaacctgctggccaacgtgtaccaccagatcaaccacctgaagaccgtgctggaggagaagctggagaaggaggacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2074 - DNA, 561 bp, artificial sequence
  IFN-beta 1 (102)
atgaccaacaagtgcctgctgcagatcgccctgctgctgtgcttctccaccaccgccctgtccatgtcctacaacctgctgggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggacaactcctccaccggctggaacgagaccatcgtggagaacctgctggccaacgtgtaccaccagatcaaccacctgaagaccgtgctggaggagaagctggagaaggaggacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2075 - skipped

SEQ ID NO: 2076 - DNA, 561 bp, artificial sequence
  IFN-beta 1 (138)
atgaccaacaagtgcctgctgcagatcgccctgctgctgtgcttctccaccaccgccctgtccatgtcctacaacctgctgggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggactcctcctccaccggctggaacgagaccatcgtggagaacctgctggccaacgtgtaccaccagatcaaccacctgaagaccgtgctggaggagaagctggagaagaccgacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2077 - DNA, 561 bp, artificial sequence
  IFN-beta 1 (31,102)
atgaccaacaagtgcctgctgcagatcgccctgctgctgtgcttctccaccaccgccctgtccatgtcctacaacctgtccggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggacaactcctccaccggctggaacgagaccatcgtggagaacctgctggccaacgtgtaccaccagatcaaccacctgaagaccgtgctggaggagaagctggagaaggaggacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2078 - skipped

SEQ ID NO: 2079 - DNA, 561 bp, artificial sequence
  IFN-beta 1 (31,138)
atgaccaacaagtgcctgctgcagatcgccctgctgctgtgcttctccaccaccgccctgtccatgtcctacaacctgtccggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggactcctcctccaccggctggaacgagaccatcgtggagaacctgctggccaacgtgtaccaccagatcaaccacctgaagaccgtgctggaggagaagctggagaagaccgacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2080 - skipped

SEQ ID NO: 2081 - DNA, 561 bp, artificial sequence
  IFN-beta 1 (102,138)
atgaccaacaagtgcctgctgcagatcgccctgctgctgtgcttctccaccaccgccctgtccatgtcctacaacctgctgggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggacaactcctccaccggctggaacgagaccatcgtggagaacctgctggccaacgtgtaccaccagatcaaccacctgaagaccgtgctggaggagaagctggagaagaccgacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2082-2083 - skipped (2 entries)

SEQ ID NO: 2084 - DNA, 561 bp, artificial sequence
  IFN-beta 1 (31,102,138)
atgaccaacaagtgcctgctgcagatcgccctgctgctgtgcttctccaccaccgccctgtccatgtcctacaacctgtccggcttcctgcagcgctcctccaacttccagtgccagaagctgctgtggcagctgaacggccgcctggagtactgcctgaaggaccgcatgaacttcgacatccccgaggagatcaagcagctgcagcagttccagaaggaggacgccgccctgaccatctacgagatgctgcagaacatcttcgccatcttccgccaggacaactcctccaccggctggaacgagaccatcgtggagaacctgctggccaacgtgtaccaccagatcaaccacctgaagaccgtgctggaggagaagctggagaagaccgacttcacccgcggcaagctgatgtcctccctgcacctgaagcgctactacggccgcatcctgcactacctgaaggccaaggagtactcccactgcgcctggaccatcgtgcgcgtggagatcctgcgcaacttctacttcatcaaccgcctgaccggctacctgcgcaac

SEQ ID NO: 2085-2087 - skipped (3 entries)

SEQ ID NO: 2088 - DNA, 621 bp, H. sapiens
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaaggagcgccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2089 - DNA, 621 bp, artificial sequence
  IFN-kappa (31)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaaggagcgccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2090 - DNA, 621 bp, artificial sequence
  IFN-kappa (102)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaaggagcgccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2091 - DNA, 621 bp, artificial sequence
  IFN-kappa (108)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaacgagacccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2092 - DNA, 621 bp, artificial sequence
  IFN-kappa (138)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaaggagcgccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2093 - DNA, 621 bp, artificial sequence
  IFN-kappa (31,102)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaaggagcgccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2094 - DNA, 621 bp, artificial sequence
  IFN-kappa (31,108)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaacgagacccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2095 - DNA, 621 bp, artificial sequence
  IFN-kappa (31,138)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaaggagcgccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2096 - DNA, 621 bp, artificial sequence
  IFN-kappa (102,108)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaacgagacccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2097 - DNA, 621 bp, artificial sequence
  IFN-kappa (102,138)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaaggagcgccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2098 - DNA, 621 bp, artificial sequence
  IFN-kappa (108,138)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaccttcaagtactggaacgagacccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2099 - DNA, 621 bp, artificial sequence
  IFN-kappa (31,102,108)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaacgagacccacctgaagcagatccagatcggcctggaccagcaggccgagtacctgaaccagtgcctggaggaggacgagaacgagaacgaggacatgaaggagatgaaggagaacgagatgaagccctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2100 - DNA, 621 bp, artificial sequence
  IFN-kappa (31,102,138)
atgtccaccaagcccgacatgatccagaagtgcctgtggctggagatcctgatgggcatcttcatcgccggcaccctgtccctggactgcaacctgtccaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaaggagcgccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2101 - DNA, 621 bp, artificial sequence; identical to SEQ ID NO: 2100
  IFN-kappa (31,108,138)

SEQ ID NO: 2102 - DNA, 621 bp, artificial sequence
  IFN-kappa (102,108,138)
atgtccaccaagcccgacatgatccagaagtgcctgtggctggagatcctgatgggcatcttcatcgccggcaccctgtccctggactgcaacctgctgaacgtgcacctgcgccgcgtgacctggcagaacctgcgccacctgtcctccatgtccaactccttccccgtggagtgcctgcgcgagaacatcgccttcgagctgccccaggagttcctgcagtacacccagcccatgaagcgcgacatcaagaaggccttctacgagatgtccctgcaggccttcaacatcttctcccagcacaacttctcctactggaacgagacccacctgaagcagatccagatcggcctggaccagcaggccgagtacctgaaccagtgcctggaggaggacgagaacgagaacgaggacatgaaggagatgaaggagaacgagatgaagacctccgaggcccgcgtgccccagctgtcctccctggagctgcgccgctacttccaccgcatcgacaacttcctgaaggagaagaagtactccgactgcgcctgggagatcgtgcgcgtggagatccgccgctgcctgtactacttctacaagttcaccgccctgttccgccgcaag

SEQ ID NO: 2103 - DNA, 621 bp, artificial sequence; identical to SEQ ID NO: 2102
  IFN-kappa (31,102,108,138)

SEQ ID NO: 2104 - DNA, 585 bp, H. sapiens
atggccctgctgttccccctgctggccgccctggtgatgacctcctactcccccgtgggctccctgggctgcgacctgccccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagcgctcctccgccgcctggaacatgaccctgctggaccagctgcacaccggcctgcaccagcagctgcagcacctggagacctgcctgctgcaggtggtgggcgagggcgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2105 - DNA, 585 bp, artificial sequence
  IFN-omega 1 (31)
atggccctgctgttccccctgctggccgccctggtgatgacctcctactcccccgtgggctccctgggctgcaacctgtcccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagcgctcctccgccgcctggaacatgaccctgctggaccagctgcacaccggcctgcaccagcagctgcagcacctggagacctgcctgctgcaggtggtgggcgagggcgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2106 - DNA, 585 bp, artificial sequence
  IFN-omega 1 (102)
atggccctgctgttccccctgctggccgccctggtgatgacctcctactcccccgtgggctccctgggctgcgacctgccccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagaactcctccgccgcctggaacatgaccctgctggaccagctgcacaccggcctgcaccagcagctgcagcacctggagacctgcctgctgcaggtggtgggcgagggcgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2107 - skipped

SEQ ID NO: 2108 - DNA, 585 bp, artificial sequence
  IFN-omega 1 (138)
atggccctgctgttccccctgctggccgccctggtgatgacctcctactcccccgtgggctccctgggctgcgacctgccccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagcgctcctccgccgcctggaacatgaccctgctggaccagctgcacaccggcctgcaccagcagctgcagcacctggagacctgcctgctgcaggtggtgggcgagaccgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2109 - DNA, 585 bp, artificial sequence
  IFN-omega 1 (31,102)
atggccctgctgttccccctgctggccgccctggtgatgacctcctactcccccgtgggctccctgggctgcaacctgtcccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagaactcctccgccgcctggaacatgaccctgctggaccagctgcacaccggcctgcaccagcagctgcagcacctggagacctgcctgctgcaggtggtgggcgagggcgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2110 - skipped

SEQ ID NO: 2111 - DNA, 585 bp, artificial sequence
  IFN-omega 1 (31,138)
atggccctgctgttccccctgctggccgccctggtgatgacctcctactcccccgtgggctccctgggctgcaacctgtcccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagcgctcctccgccgcctggaacatgaccctgctggaccagctgcacaccggcctgcaccagcagctgcagcacctggagacctgcctgctgcaggtggtgggcgagaccgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2112 - skipped

SEQ ID NO: 2113 - DNA, 585 bp, artificial sequence
  IFN-omega 1 (102,138)
atggccctgctgttccccctgctggccgccctggtgatgacctcctactcccccgtgggctccctgggctgcgacctgccccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagaactcctccgccgcctggaacatgaccctgctggaccagctgcacaccggcctgcaccagcagctgcagcacctggagacctgcctgctgcaggtggtgggcgagaccgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2114-2115 - skipped (2 entries)

SEQ ID NO: 2116 - DNA, 585 bp, artificial sequence
  IFN-omega 1 (31,102,138)
atggccctgctgttccccctgctggccgccctggtgatgacctcctactcccccgtgggctccctgggctgcaacctgtcccagaaccacggcctgctgtcccgcaacaccctggtgctgctgcaccagatgcgccgcatctcccccttcctgtgcctgaaggaccgccgcgacttccgcttcccccaggagatggtgaagggctcccagctgcagaaggcccacgtgatgtccgtgctgcacgagatgctgcagcagatcttctccctgttccacaccgagaactcctccgccgcctggaacatgaccctgctggaccagctgcacaccggcctgcaccagcagctgcagcacctggagacctgcctgctgcaggtggtgggcgagaccgagtccgccggcgccatctcctcccccgccctgaccctgcgccgctacttccagggcatccgcgtgtacctgaaggagaagaagtactccgactgcgcctgggaggtggtgcgcatggagatcatgaagtccctgttcctgtccaccaacatgcaggagcgcctgcgctccaaggaccgcgacctgggctcctcc

SEQ ID NO: 2117-2119 - skipped (3 entries)

SEQ ID NO: 2120 - DNA, 624 bp, H. sapiens
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctgggaggagaaccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2121 - DNA, 624 bp, artificial sequence
  IFN-tau (31)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctgggaggagaaccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2122 - DNA, 624 bp, artificial sequence
  IFN-tau (102)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctgggaggagaaccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2123 - DNA, 624 bp, artificial sequence
  IFN-tau (108)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctggaacgagacccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2124 - DNA, 624 bp, artificial sequence
  IFN-tau (138)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctgggaggagaaccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2125 - DNA, 624 bp, artificial sequence
  IFN-tau (31,102)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctgggaggagaaccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2126 - DNA, 624 bp, artificial sequence
  IFN-tau (31,108)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctggaacgagacccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2127 - DNA, 624 bp, artificial sequence
  IFN-tau (31,138)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctgggaggagaaccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2128 - DNA, 624 bp, artificial sequence
  IFN-tau (102,108)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctggaacgagacccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2129 - DNA, 624 bp, artificial sequence
  IFN-tau (102,138)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctgggaggagaaccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2130 - DNA, 624 bp, artificial sequence
  IFN-tau (108,138)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctggaacgagacccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2131 - DNA, 624 bp, artificial sequence
  IFN-tau (31,102,108)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctggaacgagacccacaccgagaagttcctgatccagctgcaccagcagctggagtacctggaggccctgatgggcctggaggccgagaagctgtccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2132 - DNA, 624 bp, artificial sequence
  IFN-tau (31,102,138)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctgggaggagaaccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2133 - DNA, 624 bp, artificial sequence
  IFN-tau (31,108,138)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacatctccctggacggctggaacgagacccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2134 - DNA, 624 bp, artificial sequence
  IFN-tau (102,108,138)
atgatcatcaagcacttcttcggcaccgtgctggtgctgctggcctccaccaccatcttctccctggacctgaagctgatcatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctggaacgagacccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2135 - DNA, 624 bp, artificial sequence
  IFN-tau (31,102,108,138)
atgatcatcaagcacttcttcggcaccgtgctggtgctgctggcctccaccaccatcttctccctggacctgaacctgtccatcttccagcagcgccaggtgaaccaggagtccctgaagctgctgaacaagctgcagaccctgtccatccagcagtgcctgccccaccgcaagaacttcctgctgccccagaagtccctgtccccccagcagtaccagaagggccacaccctggccatcctgcacgagatgctgcagcagatcttctccctgttccgcgccaacaactcctccgacggctggaacgagacccacaccgagaagttcctgatccagctgcaccagcagctggagtacctggaggccctgatgggcctggaggccgagaagacctccggcaccctgggctccgacaacctgcgcctgcaggtgaagatgtacttccgccgcatccacgactacctggagaaccaggactactccacctgcgcctgggccatcgtgcaggtggagatctcccgctgcctgttcttcgtgttctccctgaccgagaagctgtccaagcagggccgccccctgaacgacatgaagcaggagctgaccaccgagttccgctccccccgc

SEQ ID NO: 2136 - DNA, 567 bp, artificial sequence
  Infergen consensus interferon
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctgggacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2137 - DNA, 567 bp, artificial sequence
  Infergen (31)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctgggacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2138 - DNA, 567 bp, artificial sequence
  Infergen (102)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctgggacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2139 - DNA, 567 bp, artificial sequence
  Infergen (108)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctggaacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2140 - DNA, 567 bp, artificial sequence
  Infergen (138)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctgggacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2141 - DNA, 567 bp, artificial sequence
  Infergen (31,102)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctgggacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2142 - DNA, 567 bp, artificial sequence
  Infergen (31,108)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctggaacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2143 - DNA, 567 bp, artificial sequence
  Infergen (31,138)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctgggacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2144 - DNA, 567 bp, artificial sequence
  Infergen (102,108)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctggaacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2145 - DNA, 567 bp, artificial sequence
  Infergen (102,138)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctgggacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2146 - DNA, 567 bp, artificial sequence
  Infergen (108,138)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctggaacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2147 - DNA, 567 bp, artificial sequence
  Infergen (31,102,108)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctggaacgagtccctgctggagaagttctacaccgagctgtaccagcagctgaacgacctggaggcctgcgtgatccaggaggtgggcgtggaggagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2148 - DNA, 567 bp, artificial sequence
  Infergen (31,102,138)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctgggacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2149 - DNA, 567 bp, artificial sequence
  Infergen (31,108,138)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaaggactcctccgccgcctggaacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2150 - DNA, 567 bp, artificial sequence
  Infergen (102,108,138)
atggccctgcccttcgccctgatgatggccctggtggtgctgtcctgcaagtcctcctgctccctgggctgcgacctgccccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctggaacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2151 - DNA, 567 bp, artificial sequence
  Infergen (31,102,108,138)
atggccctgcccttcgccctgatgatggccctggtggtgctgtcctgcaagtcctcctgctccctgggctgcaacctgtcccagacccactccctgggcaaccgccgcgccctgatcctgctggcccagatgcgccgcatctcccccttctcctgcctgaaggaccgccacgacttcggcttcccccaggaggagttcgacggcaaccagttccagaaggcccaggccatctccgtgctgcacgagatgatccagcagaccttcaacctgttctccaccaagaactcctccgccgcctggaacgagtccctgctggagaagttctacaccgagctgtaccagcagctgaacgacctggaggcctgcgtgatccaggaggtgggcgtgaccgagacccccctgatgaacgtggactccatcctggccgtgaagaagtacttccagcgcatcaccctgtacctgaccgagaagaagtactccccctgcgcctgggaggtggtgcgcgccgagatcatgcgctccttctccctgtccaccaacctgcaggagcgcctgcgccgcaaggag

SEQ ID NO: 2152 - DNA, 498 bp, artificial sequence
  DARBEPOETIN ALFA
gcccccccccgcctgatctgcgactcccgcgtgctggagcgctacctgctggaggccaaggaggccgagaacatcaccaccggctgcaacgagacctgctccctgaacgagaacatcaccgtgcccgacaccaaggtgaacttctacgcctggaagcgcatggaggtgggccagcaggccgtggaggtgtggcagggcctggccctgctgtccgaggccgtgctgcgcggccaggccctgctggtgaactcctcccaggtgaacgagaccctgcagctgcacgtggacaaggccgtgtccggcctgcgctccctgaccaccctgctgcgcgccctgggcgcccagaaggaggccatctccccccccgacgccgcctccgccgcccccctgcgcaccatcaccgccgacaccttccgcaagctgttccgcgtgtactccaacttcctgcgcggcaagctgaagctgtacaccggcgaggcctgccgcaccggcgaccgc

SEQ ID NO: 2153 - DNA, 498 bp, artificial sequence
  variant erythropoietin
gcccccccccgcctgatctgcgactcccgcgtgctggagcgctacctgctggaggccaaggaggccgagaacatcaccaccggctgcgccgagcactgctccctgaacgagaacatcaccgtgcccgacaccaaggtgaacttctacgcctggaagcgcatggaggtgggccagcaggccgtggaggtgtggcagggcctggccctgctgtccgaggccgtgctgcgcggccaggccctgctggtgaactcctcccagccctgggagcccctgcagctgcacgtggacaaggccgtgtccggcctgcgctccctgaccaccctgctgcgcgccctgggcgcccagaaggaggccatctccccccccgacgccgcctccgccgcccccctgcgcaccatcaccgccgacaccttccgcaagctgttccgcgtgtactccaacttcctgcgcggcaagctgaagctgtacaccggcgaggcctgccgcaccggcgaccgc

What is claimed is:

1. A hyperglycosylated Type 1 interferon variant of a parent Type 1 interferon, wherein the parent Type 1 interferon is selected from the group consisting of interferon alfacon-1 and interferon α14, wherein the hyperglycosylated Type 1 interferon variant is the parent Type 1 interferon that has been modified to include at least three additional glycosylation sites, wherein at least one of the additional glycosylation sites is introduced by an amino acid substitution selected from the group consisting of D31N, D102N, D108N, and E138T.

2. The hyperglycosylated Type 1 interferon variant of claim 1, wherein the parent Type 1 interferon is interferon alfacon-1.

3. The hyperglycosylated Type 1 interferon variant of claim 2, wherein the hyperglycosylated Type 1 interferon variant is interferon alfacon-1 comprising at least the amino acid substitution D102N.

4. The hyperglycosylated Type 1 interferon variant of claim 2, wherein the hyperglycosylated Type 1 interferon variant is interferon alfacon-1 comprising at least the amino acid substitution D108N.

5. The hyperglycosylated Type 1 interferon variant of claim 2, wherein the hyperglycosylated Type 1 interferon variant is interferon alfacon-1 comprising at least the amino acid substitution E138T.

6. The hyperglycosylated Type 1 interferon variant of claim 2, wherein the hyperglycosylated Type 1 interferon variant is interferon alfacon-1 comprising at least the amino acid substitutions D102N and D108N.

7. The hyperglycosylated Type 1 interferon variant of claim 2, wherein the hyperglycosylated Type 1 interferon variant is interferon alfacon-1 comprising at least the amino acid substitutions D102N and E138T.

8. The hyperglycosylated Type 1 interferon variant of claim 2, wherein the hyperglycosylated Type 1 interferon variant is interferon alfacon-1 comprising at least the amino acid substitutions D108N and E138T.

9. The hyperglycosylated Type 1 interferon variant of claim 2, wherein the hyperglycosylated Type 1 interferon variant is interferon alfacon-1 comprising at least the amino acid substitutions D102N, D108N, and E138T.

10. The hyperglycosylated Type 1 interferon variant of claim 2, wherein the hyperglycosylated Type 1 interferon variant is selected from the group consisting of an amino acid sequence set forth in SEQ ID NOS: 1769-1773.

11. The hyperglycosylated Type 1 interferon variant of claim 1, wherein the parent Type 1 interferon is interferon α14.

12. The hyperglycosylated Type 1 interferon variant of claim 11, wherein the hyperglycosylated Type 1 interferon variant is interferon α 14 comprising at least the amino acid substitution D108N.

13. The hyperglycosylated Type 1 interferon variant of claim 11, wherein the hyperglycosylated Type 1 interferon variant is interferon α 14 comprising at least the amino acid substitution E138T.

14. The hyperglycosylated Type 1 interferon variant of claim 11, wherein the hyperglycosylated Type 1 interferon variant is interferon α 14 comprising at least the amino acid substitution D108N and E138T.

15. A pharmaceutical composition comprising the hyperglycosylated Type 1 interferon variant of claim 1; and a pharmaceutically acceptable excipient.

16. The composition of claim 15, wherein the pharmaceutically-acceptable excipient is suitable for oral delivery.

17. The composition of claim 15, wherein the pharmaceutically-acceptable excipient is suitable for parenteral delivery.

18. The hyperglycosylated Type 1 interferon variant of claim 2, wherein the hyperglycosylated Type 1 interferon variant is interferon alfacon-1 comprising at least the amino acid substitutions D31N and D102N.

19. The hyperglycosylated Type 1 interferon variant of claim 3, further comprising the amino acid substitution S104T.

20. The hyperglycosylated Type 1 interferon variant of claim 1, further comprising the amino acid substitution S104T.

21. The hyperglycosylated Type 1 interferon variant of claim 2, wherein the hyperglycosylated Type 1 interferon variant is interferon alfacon-1 comprising at least the amino acid substitution D31N.

22. The hyperglycosylated Type 1 interferon variant of claim 2, wherein the hyperglycosylated Type 1 interferon variant is interferon alfacon-1 comprising at least the amino acid substitutions D31N and D108N.

23. The hyperglycosylated Type 1 interferon variant of claim 2, wherein the hyperglycosylated Type 1 interferon variant is interferon alfacon-1 comprising at least the amino acid substitutions D31N and E138T.

24. The hyperglycosylated Type 1 interferon variant of claim 2, wherein the hyperglycosylated Type 1 interferon variant is interferon alfacon-1 comprising at least the amino acid substitutions D31N, D102N, and D108N.

25. The hyperglycosylated Type 1 interferon variant of claim 2, wherein the hyperglycosylated Type 1 interferon variant is interferon alfacon-1 comprising at least the amino acid substitutions D31N, D102N, and E138T.

26. The hyperglycosylated Type 1 interferon variant of claim 2, wherein the hyperglycosylated Type 1 interferon variant is interferon alfacon-1 comprising at least the amino acid substitutions D31N, D108N, and E138T.

27. The hyperglycosylated Type 1 interferon variant of claim 2, wherein the hyperglycosylated Type 1 interferon variant is interferon alfacon-1 comprising at least the amino acid substitutions D31N, D102N, D108N, and E138T.

\* \* \* \* \*

UNITED STATES PATENT AND TRADEMARK OFFICE
CERTIFICATE OF CORRECTION

PATENT NO. : 7,597,884 B2
APPLICATION NO. : 11/351163
DATED : October 6, 2009
INVENTOR(S) : Blatt et al.

It is certified that error appears in the above-identified patent and that said Letters Patent is hereby corrected as shown below:

| Column | Line | |
|---|---|---|
| (Item 56) Page 2 Col. 1 | 44 | Under U.S. Patent Documents, change "5,700,862" to --5,700,662--. |
| 1 | 9 | After "2005;" insert --now abandoned--. |
| 5 | 36 | Change "[D102N; G38T]" to --[D102N, G138T]--. |
| 6 | 47-48 | Change "interferona7," to --interferon α7,--. |
| 6 | 48 | Change "interferona7," to --interferon α7,--. |
| 6 | 48 | Change "interferona7," to --interferon α7,--. |
| 7 | 18 | Change "α 13" to --α13--. |
| 7 | 19 | Change "α113," to --α13,--. |
| 7 | 50 | Change "α 17" to --α17--. |
| 7 | 57 | Change "E38T]" to --E138T]--. |
| 8 | 36 | Change "αj1," to --αJ1,--. |
| 8 | 52 | Change "K," to --κ,--. |
| 10 | 44 | Change "IFN-α." to --IFN-αc.--. |
| 11 | 37 | Change "IFN-α1" to --IFN-ω1--. |
| 11 | 47 | Change "IFN-11" to --IFN-β1--. |
| 11 | 57 | Change "erythropoeitin," to --erythropoietin,--. |
| 12 | 64 | Change "phosphoroamidites;" to --phosphoramidites;--. |
| 12-13 | 67-1 | Change "phosphoroamidate." to --phosphoramidate.--. |
| 13 | 25 | After "(1970)" insert --.--. |
| 17 | 28-29 | Change "berizodopa," to --benzodopa,--. |
| 17 | 32 | Change "trimethylolomelamine;" to --trimethylolmelamine;--. |
| 17 | 40-41 | Change "chlomaphazine," to --chlornaphazine,--. |
| 17 | 45 | Change "foremustine," to --fotemustine,--. |
| 17 | 52 | Change "chromomophores)" to --chromophores)--. |

| 17 | 52 | Change "aclacinomysins," to --aclacinomycins,--. |
| 17 | 53 | Change "authramycin," to --anthramycin,--. |
| 17 | 54 | Change "carabicin," to --carubicin,--. |
| 17 | 56 | Change "doxorubincin" to --doxorubicin--. |
| 17 | 61 | Change "potfiromycin," to --pofiromycin,--. |
| 18 | 5 | Change "frolinic" to --folinic--. |
| 18 | 8 | Change "edatraxate;" to --edatrexate;--. |
| 18 | 8-9 | Change "elfomithine;" to --eflornithine;--. |
| 18 | 26 | Change "mitroxantrone; vancristine;" to --mitoxantrone; vincristine;--. |
| 18 | 28 | Change "xeoloda;" to --xeloda;--. |
| 23 | 42 | Change "glycoyslation" to --glycosylation--. |
| 26 | 39 | Change "docecyl" to --dodecyl--. |
| 32 | 28 | Change "type I" to --type 1--. |
| 36 | 6 | Change "IU/m" to --IU/m$^2$--. |
| 37 | 8 | Change "αchymotrypsin" to --α-chymotrypsin--. |
| 39 | 11 | Change "3fold," to --3-fold,--. |
| 40 | 48 | Change "Epogin®" to --Epogen®--. |
| 41 | 9 | Change "Cerazyme® (imiglucarase;" to --Cerezyme® (imiglucerase;--. |
| 41 | 16 | Change "gastin," to --gastrin,--. |
| 50 | 23 | Change "IFN αb;" to --IFN α 2b;--. |
| 51 | 56 | Change "P115696;" to --P15696;--. |
| 52 | 14 | Change "[1102N]" to --[I102N]--. |
| 52 | 16 | Change "1102N]" to --I102N]--. |
| 52 | 34 | Change "IFN-β" to --IFN-ω--. |
| 52 | 53-54 | Change "IFN-α1" to --IFN-ω1--. |
| 52 | 59 | Change "iste" to --site--. |
| 53 | 43 | Change "co" to --ω--. |
| 53 | 43 | Change "co" to --ω--. |
| 53 | 44 | Change "co" to --ω--. |
| 53 | 45 | Change "co" to --ω--. |
| 53 | 46 | Change "co" to --ω--. |
| 53 | 47 | Change "co" to --ω--. |
| 53 | 48 | Change "Co" to --ω--. |
| 56 | 26-27 | Change "eryhropoietin" to --erythropoietin--. |
| 57 | 5 | Change "Ileting" to --Iletin®--. |
| 57 | 21 | Change "Lyw$^{B28}$" to --Lys$^{B28}$--. |

CERTIFICATE OF CORRECTION (continued)
U.S. Pat. No. 7,597,884 B2

| | | |
|---|---|---|
| 57 | 22 | Change "myristoyl Thr$^{B29}$" to --myristoyl–Thr$^{B29}$--. |
| 57 | 25 | Change "B29-N'-" to --B29-N$^{\varepsilon}$- --. |
| 57 | 27 | Change "B29-N'-" to --B29-N$^{\varepsilon}$- --. |
| 60 | 30 | Change "MIP-1;" to --MIP-1β;--. |
| 63 | 32 | Change "IFN-α2α," to --IFN-α2a,--. |
| 64 (Table 1) | 4 | Change "N$^o$" to --No--. |
| 64 | 35 | After "by" delete "by". (Second Occurrence) |
| 65 | 9 | Change "109:" to --109;--. |
| 75 | 15 | Change "IFN-α." to --IFN-αc.--. |
| 75 | 16 | Change "IFN-α" to --IFN-αc--. |
| 78 | 29 | Change "IFN-α1" to --IFN-αI--. |
| 85 | 47 | Change "resiude" to --residue--. |
| 86 | 59 | Change "hypeglycosylated" to --hyperglycosylated--. |
| 90 | 65 | Change "B" to --E--. |
| 91 | 1 | Change "B" to --E--. |
| 91 | 5 | Change "B" to --E--. |
| 91 | 8-9 | After "20" delete "C by R at position 20, C by S at position 20, L by T at position 20, L by D at position 20,". |
| 91 | 22 | Change "N by N" to --I by N--. |
| 91 | 22 | Change "N by Q" to --I by Q--. |
| 91 | 23 | Change "N by S" to --I by S--. |
| 91 | 23 | Change "N by T" to --I by T--. |
| 91 | 53 | Change "t by C" to --L by C--. |
| 94 | 14 | Change "3-dimentional" to --3-dimensional--. |
| 95 | 33 | Change "L by Y" to --L by V--. |
| 104 | 52 | Change "S1102T" to --S102T--. |
| 111 | 39 | Change "preotease-resistent" to --protease-resistant--. |
| 111 | 50 | Change "(HiS)$_n$," to --(His)$_n$,--. |
| 111 | 66 | Change "amylosora," to --amylovora,--. |
| 112 | 3 | Change "aerogenese;" to --aerogenes;--. |
| 112 | 5 | Change "chitobiase" to --chitobiose--. |
| 112 | 5 | Change "harseyi;" to --harveyi;--. |
| 112 | 40 | Change "picomavirus" to --picornavirus--. |
| 123 | 13 | Change "tetracetic" to --tetraacetic--. |
| 125 (Table 9) | 31 | Change "Escerichia" to --Escherichia--. |
| 125 (Table 9) | 38 | Change "Pseudomonus" to --Pseudomonas--. |

CERTIFICATE OF CORRECTION (continued)
U.S. Pat. No. 7,597,884 B2

| | | |
|---|---|---|
| 125 (Table 9) | 40 (Approx.) | Change "Xylelia" to --Xylella--. |
| 125 (Table 9) | 53 (Approx.) | Change "Bacilius" to --Bacillus--. |
| 125 (Table 9) | 58 (Approx.) | Change "carrodens" to --corrodens--. |
| 126 (Table 9) | 6 | Change "Escherchia" to --Escherichia--. |
| 126 (Table 9) | 8 | Change "Esherichia" to --Escherichia--. |
| 126 (Table 9) | 11 | Change "Bacillusa" to --Bacillus--. |
| 126 (Table 9) | 13 | Change "Haemophilius" to --Haemophilus--. |
| 133 | 34 | Change "Bames" to --Barnes--. |
| 137 | 64 | Change "luceriferases," to --luciferases,--. |
| 138 | 16 | Change "eta al.," to --et al.,--. |
| 140 | 47 | Change "opthalmopathy," to --ophthalmopathy,--. |
| 146 | 46 | Change "sequellae" to --sequelae--. |
| 150 | 35 | Change "etancercept," to --etanercept,--. |
| 153 | 49-50 | Change "epithelieal" to --epithelial--. |
| 153 | 62 | Change "menangioma," to --meningioma,--. |
| 155 | 18 | Change "pentostatine," to --pentostatin,--. |
| 155 | 29 | Change "phenoxizone" to --phenoxazone--. |
| 155 | 34 | Change "raparnycin," to --rapamycin,--. |
| 155 | 35 | Change "navelbene," to --navelbine,--. |
| 155 | 36 | Change "anastrazole," to --anastrozole,--. |
| 155 | 36 | Change "letrazole," to --letrozole,--. |
| 155 | 42 | Change "dolstatin" to --dolastatin--. |
| 155 | 47 | Change "eopthilone" to --epothilone--. |
| 155 | 52 | Change "pregestins," to --progestins,--. |
| 156 | 5 | Change "desoxyspergualin," to --deoxyspergualin,--. |
| 157 | 57 | Change "tryphostin" to --tyrphostin--. |
| 158 | 63 | Change "TGF-P" to --TGF-β--. |
| 164 | 11 | Change "amantidine," to --amantadine,--. |
| 164 | 15 | Change "virarnidine," to --viramidine,--. |
| 164 | 19 | Change "amantidine," to --amantadine,--. |
| 170 | 3 | Change "pirfendione" to --pirfenidone--. |
| 176 | 18 (Approx.) | Change "p38α," to --p38β,--. |
| 176 | 53 | Change "Nos." to --No.--. |

| | | |
|---|---|---|
| 178 | 25 | Change "H;" to --H,--. |
| 179 | 30 | Change "inol" to --indol--. |
| 179 | 38 | Before "methanone;" insert -- - --. |
| 181 | 1 | Change "[5-(4Benzyl" to --[5-(4-Benzyl--. |
| 184 | 32 | Change "carbocylic," to --carbocyclic,--. |
| 185 | 45 | Change "TNFR11)" to --TNFRII)--. |
| 185 | 46 | Change "TNFR1)." to --TNFRI).--. |
| 187 | 31 | Change "TGF-β," to --TGF-β--. |
| 187 | 64 | Change "TGF-β," to --TGF-β--. |
| 188 | 48 (Approx.) | Change "$R_7$" to --$R_7$--. |
| 188 | 53 | Change "esterifed" to --esterified--. |
| 190 | 4 | After "is" insert --,--. |
| 191 | 20 | Change "(Yarnanouchi" to --(Yamanouchi--. |
| 193 | 35 | Change "$O_2,O^{2-}$" to --$O^2,O^2$--. |
| 194 | 67 | Change "1-deoxynoj irimycin" to --1-deoxynojirimycin--. |
| 195 | 1 | Change "1-deoxynoj iromycin" to --1-deoxynojirimycin--. |
| 195 | 21 | Change "1-deoxynojiromycin" to --1-deoxynojirimycin--. |
| 195 | 49 | Change "inflanunatories," to --inflammatories,--. |
| 196 | 18 | Change "fluosinolone" to --fluocinolone--. |
| 196 | 19 | Change "flucortine" to --fluocortin--. |
| 196 | 25-26 | Change "chlorprednisone" to --chloroprednisone--. |
| 196 | 26 | Change "clocortelone," to --clocortolone,--. |
| 196 | 39 | Change "acematacin," to --acemetacin,--. |
| 196 | 40 | Change "zomepiract," to --zomepirac,--. |
| 196 | 41 | Change "flufenarnic," to --flufenamic,--. |
| 197 | 10 | Change "Lomoxicam;" to --Lornoxicam;--. |
| 197 | 35-36 | Change "Janimmineg," to --Janimmine®,--. |
| 197 | 52 | Change "Peptol," to --Pepto--. |
| 197 | 53 | Change "randine," to --ranitidine,--. |
| 197 | 59 | Change "AltemaGEL" to --AlternaGEL--. |
| 206 | 6 | Change "SI $O_2$T]" to --S102T]--. |
| 220 | 6 (Approx.) | Change "IFN-α1" to --IFN-β1--. |

| | | |
|---|---|---|
| 221 | 47 | In Claim 10, after "sequence" insert --as--. |
| 221 | 53 | In Claim 12, change "α 14" to --α14--. |
| 222 | 3 | In Claim 13, change "α 14" to --α14--. |
| 222 | 7 | In Claim 14, change "α 14" to --α14--. |

Signed and Sealed this

Thirteenth Day of April, 2010

David J. Kappos
*Director of the United States Patent and Trademark Office*